United States Patent 10,724,096 (METHODS AND COMPOSITIONS FOR INHIBITING AND TREATING NEUROLOGICAL CONDITIONS) - sequence listing, part 3

SEQ ID NO: 24 - DNA, 1026615 bp, Homo sapiens
  misc_feature (11308)..(11308): n is a, c, g, or t
  misc_feature (18017)..(18017): n is a, c, g, or t
  misc_feature (18023)..(18023): n is a, c, g, or t
  misc_feature (22779)..(22779): n is a, c, g, or t
  misc_feature (22783)..(22783): n is a, c, g, or t
  misc_feature (22831)..(22831): n is a, c, g, or t
ccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggtggcgacggcgcaggcgcagtgccccgagctcccggtcctggcccccgccctcctccctgaccgcgccccggcccgcaccccctttccccgccccttcccccgcccctgccccgcccctgccccgcctctgccccgcccctgcccccgcccctgcccccgcccctgcccccgcctctgccccgtcccgcctgcgcggatccctccgcccgctccgagggtccgcggaaagtagtcccgcgcgccctctgccctgacgcggtgtgtgccagctacccgagtgaaaggttttcgggggattaatcctgatggggtctgcggcggcccttgcccagcgccttccacatgtggagcgggccagtggtgctagttctgccgccaactctggacggttgagttcagggccactttttactcaggcacggatgtgacagaaagatggaaaagggtcttggaagaaccacatgtgccgtataacgaacgaccttttggtctgaggaggaccgtgtatatgacggtggtcccataacatgataacggagctggaaacttcctgtcctctggtgagggcttagctaaggacatttcctctcctgtatttggagatacacgtacaggtatgtcattaccgtgccaggggaataacgcacctcacacgcggtgcgggtttgcggcctagcagcagcggaccgcatcagctgcctagttgtgtagtggctgtgccatctgagtttgtgtaagttaccttgtgatgatcccacaaccgagacgcatgtctcagaatgcatggatgcatgggacgcgtgactgtacgtgttacagacgtgtttcggcgtgaggctcggcccctgctcctttaggaaacacctttcctggctcatgcggtttctagagaacactgtgtcggaatatcaatgtagagagtcagcgaaggtcatctagcagcagatgaccagccccaggccagtgaggatcacccagagtgcccgtggctgcacgacagtagtagcaggtggaagctggagcccacacctggtttgcccagcagccagttgtttttccgaggcaccgttggctgatgttttgcatacagatgattcagctgcataaaagatgtctgtcaggaaagggaagcccttggcattcagcacaggcactccctacggggtaatcgatagccgtctctgctgcttcccatgttgctcactggtaattttaagaaatgaacggcccaccttgaataagacaaggatggtgcaattatttgcgcaatggcttgaccatctagtagccaaaaatatgttaaggaatagaacagactgttcactttcaaattaaatctcttttccagtattagccaagacctctgcagcccgccctttctaaaatccatgtggcctcatccgctaaatatagagctgggttttgctgtggttagtactacatttcccaaatctctttattttggcaatgatgcctgtgactccaagtaccctttaccccaaacattatataaattttttagtaattaataccatcactccctaaatcaccttccccagggctttttggggattaaaactaaaattttataccctaaaagaaagaatttaagaaaatcatagttaagcaaagtgacaggattgttaatacgtcgggacctcaagtggggattaagtttcaacattaattttagaggagacacaaatctttctgtctcttcaaaccatagaagagacagaaagcacaacagttatttgaatagacagaagtgaatataagtgatagttgtagttaacaggaaataaagttgttaatatacttgtaaaaaaattaaatgttctgacttgaaagggactttaatattctcaccacttgtaggtaacttgctaagtaaccctaaaaaaacctttcaattcttttttttttttttttttttttgagacaagagtctcgctctgtcgcccaggctggtgtgcagtggcacgatctctgctcactgcaacctctgcctctcaggttccagccattctcctgcctcagcctcccaagtagctgggactacaggcgcacgccaccgcacctggctaatttttcatttttagtagagacagggtctcaccatgttgaccaggctggtctcaaactcctggcctcaggtgatccatccacctcggccttccaaagtgctgggattacaggtgtgagccaccgcgcctggcccgggattaagtttcaacattaattttgaaggggacacaaaccttcaaaccacagaagagagagaaagtgcatcagttatttaaacaaagggaactgaatataaacaatagttaacaggaagtaaatttaaaataataaaaagaaaatcccaagatatggagttacaaacataggacacagctaccacccctagagctcaaagatgaaagagaagctggaattattacagcttaaaggaagggcttgcagagctggaattcagatctctgaggaggtgtgttgaccagctggggctggggtcattgagcccagaggagagatcccatggggatgggactcagacctctgaggagggtccctacgggacttagacacacactatggatgaggggtggctgtggagctgggagtaagccctctaaagagggcactgggagactctcacccagatctctaaggagaaggcatactgaggctggttctgcaagtcttggaaaaacttaaactggattcagcttctgtgggaagaatgtgctgctgccttgttgaagaagcctagctggggtgatgctcacaggaagtggccctgtggtctccctctatcaacctatcagcttagtctaatagggaatattagatcagatcttctttatttgccaatgagaaatatgttttttagagtctcagccctggcatcagaagcagtgtctagaggtgggaagggagaatagagctgaaagacattatttaataactggtacaagaaacgacatgttatagctaaattccaattcccatgggactttcctataggtggaattgaaaagtctgtggaggcgtataatcgcagcgctttgggaggctgaggtaggaggattgcttgagcccaggagttcaagaccagcctggtcaaccccatctcttcaaaaaaatttaaaaattaacagggcatggtgatgcatgtctataggcctagttgggaggctgcaacaggaggatcacttgagcccatgagctcaaggttacagtaagctatgatcgtaccactatactccagcctgggcaacagagaaagaccctgtctttaaaaaagaaaaagtcactggaggactttagttttcagacagcttcagagaactaaaaaggcagtgaataattatgaggccaatatcagagagaaaggacatgagagaggtgagtggtttatggctgctttttcttgaaaggcatctgccaattccagatgaatgtttgagacactaggactctgagcagcacttttaacactctcattgccctaggacgacaaaatttggaggcttggtaccaccaaggaggtatcccactgtactgttttgggaccacaagttgtttgggactccattcaaatcatgtcagtccttgccagcagcaaatgtaaatcttccctgggaatgataacctcatccatggtctcaaattacttctacaattgttcatatgcagtgttcaacactgaatcaaaaataagtaggcatccaaggagaaaagacaaaatggttgcaaaaaacaagagcaagcctggacaacatagtgacaccctgtttctaaaaaactaataataataataattagctgagcatgcacctccagagtctgaggcaggaggatggcttgagcccaggaggtcaaggctgcagtgagccaagatcacactgctgcactctagcctcggtgatagaatgaggccctgtatctgaaacaaaaacaagaacagtaacagacaagtgagctctaggggatcaaaaaatggagttttcacaaagacttttaaataattatgcttaatatggttaagaggataaaagacaaggttaagaattttatcacaagcctgtaaattataaagaaccaaatggaaattctagaactgaaattgtgaaaattcaccagatagtgttagcatattacacacctctgaaaagagaaagctagtgatggtagagttaagtcagaagagtatatctaaattaaagcacagagataaaaggacagaaaataaagcatatgaataaattagatatagaggatacatgtagaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggcagatcacttgaggtcaggagttcgagaccagcctggccaacatggcgaaaccccatctgtgctaaaaccccgtctctactaaaaatacaaaaattacctgggcatggtggcgcatgcctgtagccccagctactcaggaggctgaggcaggagaattgcttgaacccgggaggcggaggttgcagtgagctgagatggcactacttcactccagcctgggcaacacagagtgagactctgtctcaaaaaagaaaagggaagggaaaggaagggagaaaggaagggagggagggaagaagggaaaggaaaggaagaagagaagaagggaatggaagggaaaataaagaaaataatgacattggcagacaaacaagatctgagaaaatttgttaccaaaagatctaaactaaaggaaatactaatgggtttttatcaggtcaaaataaaatgttctcaagtggaagctcagagatatagaatggataaaattcaacaaaaagtatatattggtaaatctaaatgaaagttaactgcatgacacaaaaataataaagccttctgggattaaaaatatgtcagaatttaggccgggcgcggtggctcaggcctgtaatcccagcactttgggaggccgaggccggtggatcacgaggtcaggagatcgagaccatcctggctaacatggtgaaaccccgtctctactaaaaatacaaaaaattagccgggcgtggtggcaggcgcctgtagtcccagctactcgggaggctgaggcaggagaatggcgtgaaccccagaggcagagcttgcagtgagccaagatcgtgccactgcactttagtctgggcaacagagtgaaactctgtctcaaaaaaaaaaaaaaagtcagaatttaaatatataaaatctatagtaagtcagaactggggtaatccaggcatcatctgagaaaggggtataaaaaaggttagatttgtagttgattgaataattggtcccaagtcttaaggccttgtaagagttctattcctctgcactcttgccatggctttgtagtggattgagggtgcttcttcaccccttggttccaggtttcaccctgtgccttgcttcagctcattggatgttagaagtgtgatatgagcagaaatttaactgtcccacattgtttggattgcactcttgcacttctgttgtgtccgtgagtacaatttgtcccccctagccattgccttttgagcttggagctcaggatggcatgtataaagtagatctcagcccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactacccttgtatgaaaaatgtaattctgttaaatttctttgtttgctgcctatataagtaagaccataacctttcagcttgggatcactgaccccattcctttggggtctgtatttccggatattcatcctcaactttgtgcttgcataaactcttaaactggattctgatgctttaaattatttcaggttgacatactagtgacccagatgggacctgaagttagcttctgccactgactcctgctgttttgctaacagataggtggtaccagtacagactgttgctggagtttatgggagccctaagtgagacccctcttgcattttgaatctccctggcttagatgagattcgtatattgttcaaatgacctgattccatactcaatggggctggaattaaagttctactttaaatctttaaggtaggagtttcatttcttatctctcgagagattctgttgtttgcaggtttacggtttcattcttttttaaggttaaggttttgtttgccttacttgctaaagtttgcaaccttttctctcatgcaaaatctggttaaaggaaaagcagtttccctttaataagatatgaatttctgtggcttaagcaaaattgtgaccttaaactagccaggttttgaagctcagttcaatttggcacatttaaattctttttttgagtgaccaaaaatttataaaagacctttattggctgggcacagtggctcactcctgtaatcttagcactttgggaggccgacgctggaggatcacttgagaccaggagttcgagaccagcatgggcaacatagtgagaccctgtctctgcaaaaaaataaaataaataaaaataaaaaaaaaataattaattaaaaaaaaatctttatgagaatgtgataagtcctgaaggcaacgtacactgttcatcctgaccaaaaggcaccttaggtgactgaggtcttgtaggagtgccagagattatcacttgtgatgagaaatggtcacacaggggatccccaaagaagaacatacagggaaatttgcttaaattcagtaaatatatataaggtactgatgtcccagtgccttaagctcccagaatttctgggtttcactgagacacataagaggaaagaactgatccaagggtaacacacgggggagctattcccataaataatacatttgatccaaaacatctttccctttcacttaagaggagaatacaaattataggcgatcagctatctaaaatagagtcctccttgtggagaggtccatctttagagactccagctggatacctgtacagtacttacggttttacttcttgtcattatttagaaaaattgtctcttgaagaactcacgaagaaccaaaattgcaatggccaaagtagggtactttgaaatgcctaaactaaattatttgtgtgctcaattagaaaaatccggttctggccgggcaccgtggctcacgcctgtaatcccagcactttgggaggccgaggcgggcggatcacctgaggtcaggagttcgggaccagcataaccaacatgcagaaaccccatctctactaaaaataaaaaaaaattagccgggtgcggtggcacatgcctttattcccagctactcaggaggctgaggcaggagaatcgcttgaacccaggaggcggagcttgcggtgagctgagattaggcgtcattgcactccagcctgggcaacaacagcgaaactccgtctcaaaaaaaagaaaataaaaaagaaaaagaaaaatcgggttctaggataaaatagaataattgggagatttatttttagaggtatttagaagcatccagaagaggttctgataaagttacttcactgcaggaggaaaataaaagattgcctaaaggctgggcacggtggctcacgcctgtaatcccagcactttgggaggccgaggcaggcggatcacaaggtcaggagatcaagaccatcctggctaacacggtgaaacccccatctctactaaaaaaatacaaaaaaaaaaaaaaaaaaattagctggacgtggtggcaggcgcctgtagtcccagctactcgggaggctgaggcaggagaatggcgtgaacatcggaggaggagcttgcagtgagccgagatcgcaccactgcactccagcctgggcgacagagcaagactccatctcaaaaaaaaaaaccaaacaaacaaaaggtagtcaactggcataaaatataaccatatatacaaaatccagagtcagttatgttatactttgaaagatgtaaaaagacttttagacaatattcaggcttatgtgaggtgagtgatgctaatcataaaaatgatactttcctgggctgggtgccgtggctcacacctgtaatgccagcactttgggaggccgaggtgggtggatcacctgaggtcaggagttcgagaccagcctgaccaatatggtaaaacctcgtctctactaaaaatacaaaaattagccaggcgtggtggcatgcacctgtaatcccagctacttgggaggctgaggcagaagaatcacttgaacccaggaggtggaggttgcagtgagccaagttgcgccattgcctccaccctaggcgacagagggagactctatctcaaaaaaagaaaaagaaaagatactttcctcaactccaactttatgaatgttctagataaagaattcactctaatagtaaagagacagtgccttagttgggccacttctcaaacccatgatttgattaatcttgctgacgggtcgttgtgtactttaaagaagaaaaagataaagaggccataccaaagaataaagtgagtaaagttatgaatttgcaactaaaacaagtatccaccaagtgtagacagtcaaaataccccaataaacctttgaacaggtctaatccttcaatctgtaataactacaataaaactggccactttccaaaaaagattactgaaaactaaaacagaaggaatgacaacagatgaaggaggaaaatacggaatagaggtgctccaagaaatttaaagggagctttccttttctgcttactaatattctgggaaaaatagaatttatttatttatttatttatttgagaggagtcttcgctctgtctcccagggagtgcagtggtgtaatctcgggctactgcaacctccacttcctgggttcaagcaattctactgactcagcctcctgagtagctgggattacaagcatgtgccaccatgtccagctaatttttgtatttttcgtagaggtgggttttcaccatgttggtcaggctgatctcaaactcatggcctcatgatcggtttgccttagcctctcaaagtgctgtgattacaggtgtgagccaccatgcccggcctcaatagaaattattttaagtaaagaacaataccaagtccttgttgatactgagcaacattatctgtaataaatctaaccttatcacaaagtcggggtaaacatttctgagggtaaacactcggtctaaatggtaggtgtcacaaatacttccatatcagcacacaagtctcaccctgcaacttctcaactaggtatcttacaagggaatcatgttttccttttggttccatcagcccccatccatctgataggaagagacttcttaaaactatataatgcctatatttctttctcccagaagtgggaaatatatttagaattagatggtatggatgacacaacagaattaacagacacaagcaaaaaatttttaaaaatttaatccagttactatccatctcaccattgaggacactgaattattaagcaatgaagaattagaaaacctactaaaggtagtacttgattgattgtggtcaaagtccttcactgatacagaaactattgtttcagctacttcaataacatctcataatattcatcaaaaccccttccaaatatcagatactatcccacgataaccttaggaggggtaaaacctatgatttcagattatataaaaagaggactgatcaggctgggcacggtggctcacacctgtaatcccagcactttgggaggctgaggcaggcagttagtctgaggtcaggagtttgagaccagcctggccaatgtggcaaaaccccatctctactaaaaatacaaaaaaaaaaaaaattagccaggtgtggtggcatacacctgtagtcccagctacttgggaggctaaggcaggagaatcacttgaacccgggatgcagagattgcagtgagccaagattgcgccactgcactccagcctagtgacagagtgagactccacctaaaaaaaaaagaaaaaagaaagaaaaagaaagaaagaaaaaaaaggactgatcattctctatacaagccctcataatacaccaattccccgttaagaaaaccaaatggtagaggatggagacttgtacagaatttgatagcaataaacgacataattccacagcatccggtagtgcctaatcctcacacattgctcatatctattccattgaatgcagaatttattattttgtgtgtgcgtgtatcggagtctcgctttgttgccaggctggagtgcagtggtgtgatctcggctcactgcaacctctgcttcttgggttcaagtgattctcctgcctcagcctcctgagtagctgggactacagacatgcgccatcatgcccagctaatttttgtatttttagtagggatggtttcagcatgttggccaggatggtcttgatctcttgacctcgtgatctgcctgccttggcctcctaaattgctgggattacaggtgtgagccaccatgaatgcagaactttttacagtcatagatttatgcagtgcattctttagcattcctatagataaaactggccaatttctctttgcctttacttgggaagacagacaatatacttggacattcatgctccaggatacactgaaagcctcacttacttttcacaaacattaataaaagacctctcagatgataacttcattgagaagcctgtctatttttttttttgagacagtcttgctctgttgcccaggctggattgcagtgtcacaatcatagctcactgtagccttgaactcccaggctcaagtgatcctcccacctcagcctccagagtacctgggactacacaatacaagccaccatgcctggctaatttctggttgtcctttttttttttttttttttttttttgtagagacagggtttgccttgttgcccagactggtctcaagaaaactcctgggttcaagtaatctgcctgccttggcctcccaaaattctgggattataggcataggattataagcataccacagctttttttttttttttttttttttggagacagggtctcactctgtcgcctagactggagtgcagtggcgctattacgtatcactgtagcttcggcctcctgggctcaagtgatcctcccactcaggctcccaagtagctggggccagaggcatgcacccccatgcacggctactttttttaactttttgtagagatgcgctcttactatgttgcccaggctggtctcaaactcctgactgatcctgagtcatcctcccgccttggcctcccaaagtcaaagtgttggacttacaggcatgagccaccatgcctggctgagaagcctgtctgaatacaatacatagatgatttacgtctttgcttagataacaaataggcttccacagtagatggaatacacctgttacaattggccctaatggatcataaagtgtctaaagaaaaacttcaattttgtaaaaacaaaacaaaaaaaccaaaacaactacttaggccacctaatatccaaggaatgactttctattaatcccgatagattgaatgcaattgtagctgttctgacactgagaaccaagaaacagttaatgttttagggactagcagaattttgtagaaattatactctaaacttttctttaaaagctctgcccttacatgctctcttaagataagacatgccagactctctagattggacagaagaaattcaactaatattagaaatgatcaaaaataggttgggcgtggttgttcactcctgtaatcccagcactttgggaggccgaggtgggcagattgcttgaggtcaggagtttgagaccagtctggccaatgtgatgaaaccctgtctctactaaaaagtacaaaaattagtggggtgtggtggcacactcctgtagtcccaactacttaggaggctgaggcacaagaatcacttgaacctcaaagatggaggttgtagtgagccaagatcataccactgtactccagcctgggcaacacagtgagactctgtctcaaaaaaaaaaaaaaaaaaagaaaagaaaagaaaggagaaatgatcaaaaatgaccttgctaacactccagctttggggcatccaaattataacatttcattatttgtgtatgaaagtggtggaaacaacactttaggggtcctaacccaaaaaaagagttcaaaatagacctatagggtattagagccaacaattagacactgtagcaaaaggactcccaccttgtatgagagccataacagccaccatttgttcattagggcaactgaagaaattgtcatgggaacaccccttactatcttcatcccttattctgtggaggtattgctatactcacgccatacttaacattattcagttagtagactggcttcatatgagatgttgcttattttagcttctcatatcatcatctctagtgtaacgatgtaagccctgcattcttttgccttcatttttacatgaaatgccacacaactgcatagctctaagtgatcaacatttttcttctaggtcagacctccaagagactccctttatgaatactgatgctatttggttcacagatggatgttacttgaaggatgaatcttgaatctaccaagcaggttgcactataatgtctttaagtgaggaaatagaaagtgcctattttctgaaagccatctcagctcaataaaaggaattaatagcattgaataggcctgtcaattggcaaaaagaatatgtgctaatatttatacagacagtagacatacttttggagtagcccatgatttggaaatgttatagaagcaaagagtgttcgtaacctcttaaggccaatccataaaaaacaaacttcttatttcatgactactagaaaaaatccctggccattattaaaattttgggtcattccaaatcagatactccagaaagcagaggatatcagctagctgataagtagcaaatagagctgctctaaacacatctaaacaagagaaccaacctgtgttaacttttaaggaaggacctgaatttgacataaaattagctcaattcagagccctaaaatcagaacaaaaagattgggaaacaaaagggggggaatagattccccaaaagatgaggtatggtatgggccaaacaagttgcccgtactttctgctgaattttagttgttattattattttttttgagacagagtttcactcttcttgcccaggctggagtgcagtgatgtgatctcggctcactacgacctcttcctcctgggcttcagcaattctcattcctcagcctcccagtgaatggagttttgctcttgttgcccaggctggagtgcagtggcgcagtcttggctcactgcaacctccacctctcaggtcaagcaattctcctgcctcagccaccacacctggctaatttttctgtatttttagcagagacagggttttcatcatgttggccaggctgatctcgaactcctgacctcaggtgatccacccgccttggtctcccaaagtgctgggattacaagcatgagccactgcgccctgtcatttccacattttttaggtatttcttacaagcagcaccccactcctcacgttaatctcatctagaaatgcccttacatacacagccagaataacgtttaatcaaatatctgggcactgtgtgacccagtcaagcaagttgacacataaccatcataaatatcaaagtatttgtggaaatattttaaaaactgctacaacatgtatattggcctggtgtggtggctcacacctgtaattccagcactttgggaggccaaggcaggcggatcacctgaggtcagaagttcaagacgagcatagccaacagggtgaaaccctgtcttgactaaaaatacaagaagaagattagccagccatggtagtgcacgcctgtagtcccagctactcagaaggttgaggcacaagaatcgcttgaacctggaaggcggatgttgcagtgagctgagatcgcaccactgcactccatcctgggcaacagagtgagactctctctcaaaaaaacccaacactgctacaacatgtgtataggtttccttgtgatatatttatatttacaaaatacatacttacaaatatatacatctgtatttactaaaacgtgattttttaaagacagaatctcactcacattgcccaggccggagtgtagttgcatgatcatggctaactgcagcctcaacttcccaggttcaggtgatcatctcacctcggcctcccaagtagcagagacaataagcatgcaccactacacctgactaattttttaattttttgtagagacagggttttgccatgttgcccaggctggtttcgagctcctgggctcaagccatctacctgccacagcctcccaatgcgctgtgattacagccatgagccaccacactcagcctcaaaagtattttaataagagagactagaaaatatcttcatggaacagttaaccataagaaatgacccaacgagccagacatggttgttcatgcctgtttattgatttggtatcctgctactttgctggattcacttcttagttgtaaccactgtgtatgcatgtgtgtgtgtgtgtgtatgtgcgtgtgtgtaatccttgatttaagattgtgtcatctgtgaacacagatcatcttttttcctttccaatttgcatgccttatatttctttttcttgtctaactgctgtggctagagattccttcctatgtagaatagaagtggcaagagtaggcatccttgtcttcttcctgattttagtggaaaagcttgccattattgtgttgaggcaattttcttctattactagtttgttgagtgttttatcataaaagactgttgaattttatcaaatgctttttctgcatcattgagataatcatgtagtttttcccattcattctgttaatgtcatgttttgggtgaagtaatctgtttacgcctgttaggtttaattggggtttattgtgttaagtcctctgtttctttagttaccgtctcatctgattgctctatacctatcattgaaatttggcagttgaaggccgggcgtggtggctcacgcctgtaatcctagcactttgggaggtgaaagcgggtggatcacgaggccagaagatcgagaccatcctagctaacatggtgaaaccccatctctactaaaaatacaaaaaattagccaggcatggtggtgtgtgcctgtagtcccagctactggggaggctgaggcaggagaatggcatgaacccgagaggcggagcttgaagtgagctgagatcgtgccactgcactccagcctgggcagcagagtgagactctgtctcaaaaaaaaaaaaaaaaaaaaagaaagttggcgattgaagtctctaacaattattgcagaactatctttttcccttcatttctgtccatttttgcttcatatatattgagggtttgctattaggtgtgtaaatctatatgattcttatatcttattgatatattgaaccgtttgttaatatataatattcttatcttttgtaatctttttaatttaaagtttattatatctgatattagcatagccagtccagctgtcctgtatttaatatttgtataggatatctttttcaatccttttacttttaacctatttgcatctttaatggaaagtgaacatctcttataggcagcctgtatttaaatcatgtgtttctagccaggcatgttggctcacgcctgtaatcccagcactttgggaggcctaggcgggtggatcacttgaggccaagagtttgagaccagcgtggccaacatggcaaaagcacattggtactaaaaatataaacattagctgggcgtggtgacacgcaccttcagtctgagctactcaggaggctgaggcatgagaatcgcttgaatctggaaggcagagtttgcagtgagtggaaatcatgccactgccagccagcctgggcaacagagctagactctgtctcaaaaaataaataaataaataaataaaataaaaatcatgtgtttcgattcttctgctaatctctcatttaactgggaattttaattcttggtattttgctatttgttttctatatgccctacagttgttgtttttttttttttttgtacctcatttccttcattactatcttctttgtttagtttattttaaatagtgaaccattttgattcccttctcatttcctttttttgcttttttgagacagagtctcactctgtagtccagtctggagtgcaatggcacaatcttggcttattgcaacctccacctcccaggttcaagtgattctcatgcctcagccccctgagtagctgggattacaggcgtgtgccaccacacccggctaatttatatattttttagtagagacagggtttcgccatgttggccaggctggtctcaaactcctggcctcaagtgatctgcctgccttggcctcccaaagtgctgggattgcaggcgtgagccactgtgctggcttctttttccccacctttttttggagacggagtcttgtactgtcgcccaggctggagtgcagtgatgtgctcttggctcactgcaacttccacctccagggttcaagcgattctcctgcctcagcctcctgagtagctgggactacaggtgcccaccgccatgcctggctaattttttgtattttagtagagaccaggttttgctgtgttgtccaggctggtcttgaacgcctgagctcaggcaatccacctgcctcggcctaccaaagtgctgggattacaggcgtgagccacgacgcccaggcttttttttgttttttttttgagacagtttctgtcacccaggctggagtgcaatggcatgatcatggctcactgcagcctcagtcttcctcagtctccttgaggtgatcctcctacctcagcctcctgagtagctaggactatagacatgcaccactacacctgattaatttttgtacttcttgtagaaacagggtttcacgttgttgcccaggctgttctcagactcctgggctcaaggaatctgcctgtttcagtctcccaaagtgttgagattacaggcatgaacgactgtgtctggccttcatttccttttgtctacaatttatagattttttgagataaccatgggaatttattttaacatcctaaatttgaatacaattttaacttcaatactgtataaaactctgcttctgacagggcgtggtggctcacgcctgtaatcccagcactttgggaggccgaggcgggtggatcctgaggtcaagagattgagaccatcctggccaacatggtgaaaccctgtctctactaaaacatacaaaaatttgctgggcatggtgacacacgcctgtagtcccagctactcgggagactgaggcaggagaacagcttgaacccgggagacggaggttgcagtgagcggagattgtgccactgcactccagcctgggagacagggcaagactccgtctcaaaaagcaaaaaacaaaaaacaaaacaaaacaaaaaaactctgcttctatacagctcattcctcctactttcttttattgatgttacaaattacatctttatatattgtgtgctcagtaacattgactaataattgtatttatgcatttgtctcagaaatcatgtagaaaataaaaagtggagttattaaccataattataataattacccatgtatttacctttaccacagatatttatttctttttactttttatttatttatttatttatttatttttgagacaggttctcgctctgtcacccaggccagagtacagtggcaccatcatagctcactgcagcctcaacctcccaggttcaagtgatccgatcctcccacctcagcctcttgagtagctgggactacaggtgcatgggaaccacacccagctcattttttttgtatattttgtagagacaaggttttgccatggtgctcaggctggtctcaatctcctgagctcaagcagtccactcacctaggccactcaaagtgctgggattacaggcatgagccaccatgtcttccctgtttatttctttatacagctttgagttgctgtgtagtattccttcatttctgtatggacttcctctgtcatttcttgcaggacagctctggtgttaataaattcactcagattttagttatctgggaatatctcaatttctggatcacttgaggtcaggagttcaaaaccagcctggtcaacatgataaaaccccgtttctactaaaaatactaaagttagctgggtgtggtggcatgcaactgtagtcccagctacttgggaggctgaggcaggagaactgtttgaactggaaggcagaggttgcagtgaaccgagatcacgccactaaactccagcctgggtgacagagtgagactctgtctcaaaaaaaaaaaaaaaaaaaaaaggccgggcacagtggcttcatgcctgtaatcccagcactttgggaggctgagagagctgatcacgaggtcaggagatccagaccatcctggctaacgtgccgggtgtggtggcgggcacatgtagtcccagctactcgggaggctgaggcaggagaatggcgtgaaccgggaaggcggagcttgcagtgagctgagatggtgtcactgcactccagcctggatgacacagcgagactcctctgtctcaaaaaaaaaaaaaaagttaaccttcttacttagcaattctgtttcaaagcaagctgaaagatggaaataaatatcagaacataaatcaatgaaaatagaggccgagtgcagtggctcatgactgtaatccctgcactttggggggctgaggtggatggatcacttgaggtcaggagttcgagaacagcctggccaacatggtcaaagcctgtttctactaaaaatacaaaaattagccggccatggtggtgtgtgcctgtagtcccagctacttgggaggctgaggcaggagaatgacttgaacccgggaggcagaggttgcagtgagcagagatcatgccactgtactccagcctggaggacagagtgagactccatctcaaaaaaaaaaaaaaaaaaaaaagaaagaaaattgaaagcagaaaagatttagaaaattaaactaaaagctagttctaaaagatcaataaaatcgacaagcttctagcatgactgacaaagggaaaaagagtgaagaaaaaattaataggagttatcagtacagagcgtgcagacatcaaaaagataaggaaatactacaaacacctgtacaaacataatttgacaagtgagatgaaatggacaaattcctcaaggcaaagcaagacaaaacaaactcccactacccatctataatgaaatagataatccaattaatcatataactattaaagacattgaatttgtagttaaataatttttgaaatagaaatccacatccccagatggtttcactggataattctatcaaatgcttagataattaacaccaattctatataatctcttccagaaaacggaaagcaaatcacttccaaatttattttaaagttaagaaaaaatagtacatgctgggcctggtggctcacacctgtaatcccagcagtttgggaggctgacgtgggcagatcacttgagctgaggaatttgagaccagtgtgggcaacatggtgaaacaatgtctgtacaaaaaacaaaaattatccaggcatggtggcatgcacctgtagtcccagctacttgggaggttaatgtgggaagattgcttagacctgggagacagaggtttcagtgagctgagatcacaccactgctctccagactgggtgacagagtgagactctgtcttaaaaaaaaaaaaaaaaaagaagaagaaaaaggaaaaggaaaacaatacaaagaaagaaaactatagaccaacatgagtcatgaatatatgtgcaaaaattcttaacaagatatcataaatggaattcagcgatatataaaaataattatacaccattaccaagtggagtttatcccagaaatgtaaggctggttcaatgttcaaataccaatcaatgtgatccaccatattaacaagctaagtaagaaaaatcacatgagattatcaattgaattctgcagaaaaggcatttgacaaagtccaacacccattcatgataaaaaccaccagaaaacttagagaggaatttcttcaactgaataaaaaatatttaaagaaaaatcatgtggctatcatattcaataaagactgaatgctttttctctaagatcaacaacaaggcactcattactactattcaacaaaacactgcaagttctagacagagtctcactctgtcacccagtctggagagcagtggtgtgatctcagctcaccgaagcctctgtctcccaggtctaagcaatcttcccacattaacctcccaagtagctgggactacaggtgcatgccaccatgcctggataatttttgttttttgtacagacattgtttcaccatgttgcccacgctggtctcaaattcctcagctcaagtgatctgcccacgtcagcctcccaaactgctgggattacaggtgtgagccaccaggcccagcatgtactattttttcttaactttaaaataaatttggaagtgatttgctttctgttttctggaagagattatatagaattggtgttaattatctaagcatttgatagaattatccagtgaaaccatctggggatacagatttctatttcaataaggaaaaagaaatcaaaggtacaatagccaagatttggaatcaacctgtgtatcagcagacaaatggataaagaaaatgtgttatatatacatgatgaagtacttttcagccatgaaaaagaatgagatccagtcacttgcaacaacatagatgaaattggagaacattacgttaaatgaaatagggcaggcatagaaagacaaacttcaaatgctctcactcatttgcaggagctaaaactttaaataattgaactcatggagaatagaatggtggttaccagaggctgggaagagtagtagcattggggttggggggagtgggaatggttaatgggtacaaatttagttagaatgaataagatctagtatttgataatgcaacagggtaactacaatcaataatagtttattgtacatttaaaaataactaaaagaggccaggcgcggtggctcacgcctgtaatcccagcactttgggaggccaaggtgggcggatcacaaggtcaggagattgagaccatcttggctgacagggtgaaaccccatctctactaaagatgcaaaaaaaattagctgggcatggtggtgggtgcctgtagtcccagctacttgggaggctgaggcaggagaatggcatgaacctgggaggtggagcttgcagtgagccaagattgtgccactgcactccagcctgggtgacagagcgagacttcatctcaaaagaattaaaaaaaaaaagagtataactgaaatatttgtaacacatagaaatgataaatgcttgaggtgatgatggatatcccatttactctgatgtgattattacacattgaatgcctgtatcaacataaatatatggaccccataaatatatacaccttctatgtcctcataaaaattaaaaataattaagtttaaaaaagagtctaggcacggtggctcatgcctgtaatcccagcaccttgggaggctgaggctggcggatcacaaggtcaggagttcaagaccagcctggccaacatggcaaaatcctgtctatactaaacataccaaaattagctgggcatggtggcaggtgcctgtaatcccagctacttgggaggctgaggcaggagaatcgcttgaacctgggaggcggaagttgcagtgagctgagattatgccattgcactccagcctgggcaacaagagcaagactctgtctcaaaaaaaataataataataataattaaaaggcatactaatcagaaaagaagaaaaatttgtccctattttgagatgacgtgatttaactatatggaaagcccaaaggaataaaacaacaaaaacaaacaaaaaactcctaaaaaactaataagtgaatttagcaaggttgcaggatatatcaacatatcaaaattaattgtatttctatatactagcaaggaacacgtgggcactgaaattaaaatataatactatttataattgctccacaaaaatactttggtgtgaatctgccaatacaggtgcggaacttacatgatgaaaactagacaatgctgatgaaagaaatcaaacaagatctaaataaatggaaaggcatagcatgttcatggactagaagactcaattgtaaggacacccgttttccccaaatggtacacagttttaacacaattactatcaaaatccaagcaactttgttgttgttgttgtagatgcagacaaacttatactaaaatttgtttggaaacatacaagccctagaatagctaaaaagttttgaaacagttctgaggtgggaattaaagaaagaaagaaaaataaaattaaaaagagaaaaatatgttcaaaaaaacaagctttctgtattaggctggctcatcccaaagtcagtaacaggcaaagcccagacccaggcaaagtctcgataacattatctaagaagccagggctcaaaggaatgtgctctggagactctcccagcactccctccacataaggagaagaaaaacaaattttccttattttcctttcccctatggtatgagtacatttatgactttatagattcccgttttcttttcttttgttttctttttctttttttttgagatgaagtctcgctctgtcacccaggctggagtgcagtggtgcaatctcagctcactgcaagctccgcctcctgagttcacgccattctcctgcctcagcctcctgactagctgggactataggcgcccgccaccatgcctggctaattttttgtatttttagtagagacggggtttcaccttgttagccaggatggtctcgatctcgtgaccttgtgatccacctgcctcagcctcccaaggtgctgggattacaggcgtgagccactgcgcctggccagattcctgttttctgtaactagtaacctcaagtattctgttttttatccgagcagcacagcaaaggtcatgagacatgcctgagcaggcataatctaactgtcatagtttgattaactgcctttgttctgcttctatacacttgctttcacaccactacacttcgcatcactgtaaccttgtttcaaactagccaaccccttttcagaagtgtgtataaaagtcaagttctgtctttgttctaggcccggtctttggatgttaatccactaggccagagtgcactcaataacatccccctgttctacctattggtctctccagtctcctgattcccacaacagttccactggatctttcactgtctttgtagttttaccttttatagaatgtcacttaggtggggcgtggtggctcatgcctgtaattacagcattttgggaggctgaggcgggtggatcatttgaggtcaggagttcgagaccatcctggccaacacggtgaaaccccgtctctactaaaaatacaaaaattagccaggtgtggtggtatgcatctgtaatcccagctattcaggaggctgaggcaggagaattgcttgagcctgggaggtggaggttgcgataagcagagatcatgccactgcactccagtctgggtgacagagtgagaccctgtctcaaaaaaaaaaaacaaaaaacaacaaattgtcacttagttggaatcatacagtatgtagccttttcaaattggcttctttcacttagcaatatccatctaaggtcttccatgtcttttcatggcttggtagctcatttcttttcttttcttttttatttttctttgagatggagtctcggtctgtcgcccaggctggagtgtagtggcacgatctcagctcactgcaacctcaacctcctgggttcaggcaattctcttacctcagcctcgcaagtagctgggattacaggcacgcaccaccacacccagctgatttttgtatttttagtagagaaggggtttcaccatgttggccaggctggtcttgaattcctgacctcaggtgatctgcctgtcttgacctcccacagtgctgggattacaggcatgagccaccgtgcccggcctgagccactgcccccagccggctcatttcttatcattgaataatattccaatgtatgaatgtgtcagtttgttcattcaccaattgaggggatatcttgatttcttccagtttttgcagttttgaataaagctgctataaacattcatgtgtaggtttttatgtgtatataagttttcaactaattttggtatatacctaggagtgaaattgctgggccatatggttaggctatgtttagcttggaaggcactactagatcatcttccaaagtggctgtattctcaagagcaatgaatgagaattcctgtttttctatgtccacatccttgtcagcatttgatactgtcaggtttttggattttagcctatctaataggtgtatagtggtttctcattgttgtttttgttatttatttatttatgtatttattttagagatgggttcttactctcttgcccaggctggagtacagtggtatgatcatggctcactgcagcctcaaactgctgggttcaagaggtcctcctgtttctgcctcctaagtagctggactacaggcatatgccaccatgcccagctaattctcattgtgttctgaatttgtaattccctaatgacatatgatgtagagcgtcttttcatatggttatagccatatgtatatcttctttggtgagctccgttcagatattttgtccatttttaaactggaatgcttattttcttatttttgcattttgggagttattcgtatatattggatacaaatcctttatcagaaaagttatttgcaaatattttctccaagtctgtgggttttcattctcttagcaatgatgttctcagagcagcagttaaaaatttctgtctagattcttttttttatgtttgcatgtgtaaaatgcaaaacttcctgagtagaagggactacaggtgcatttattagagcagtatttattgaaaagactaatatttttctattgaattgcctttgttccttcatcaaagatcagttgatttcatttgtttgggtttatttatgggttctctactccgttcctttaccaatgtcacactgtcttgattactgtagcttcatagtaagtctcaaagttgagtagtgtgagtactctggccctgcttgtcttcaatattgagtgggctattctgcatcttttgactttccatacaaactttagaatttgcttgtcaatatctgcaaaataacttgctggaatcgttattggaattaaattgaatctataattggtaagcgctaacacattaatgttgagtcttcctacccatgaacatggaacttatctccatttattaatttagattttttatttatttcatcagagttttgtagtttccctcatataaagcttgtatgtattttgttagatttatacctaagtattttgattatttggtgtttatgtaagaggtattaaattttcaatttcaaattccaattgttcagtgttggttaaagaaaagcaatcaacttttgtatgttaaccttatatcctgcaatgtaactataataacttactagttctcagagttttttgttgattctttgggattttgtacatagatagtcatgttatctgcaattttttatactttatttccttcttcctaatttttatacttttatttccttcttttgtcttattgtattagctaagacttctagtacaatattgaataggagtggtgacaagagacatccttgccttttccctgatattaggggaaaagcatataatttttcaccattaagtagtgtatgatgttagccatacatacatacatagtggaattattgtagatgttcttcatcaattgagaaagttcccttctattcctagtttgctgagagtttttatcatgaataggtgttagatttgtcaaatgcttcttctaaatgtattgatataatcatgattttcttttttaacttaattgatgtgattgattacaataacttatattcaaccattaaacaagtatgcatatctggaatacatcccatttggtcatgttgtatttttttcatacaatgttggatttgatttgctaatatttttatcatggataaaaggggcattactatcgggtaaaattcagcccccgatatttcacctgggtccttttctattttccctaagtgttggctggtctgagaaataaagggaaagagtacaaaagagaaattttaaagctgggtgtctgggggagacatcacatgtcggcaggttctgtgatgccccccaagccgcaaaaccagcaagtttttattagtgattttcaaaggggagggagtgtatgaatagggtgtgggtcacagagatcacgtgcttcacaaggtaataaaatatcacaaggcaaatggaggcagggtgagatcacaggaccaatgcgaaattaaaattgctaatgaagttttgggcatgcattgtcattgataacatttatcaggagacagggtttgagaaaagacaactggtctgaccaaaatttattaggcgggaatttcctcatcctaataagcctgggagcgctacgggagaccggggcttatttcatcccttatctatgcccataaaagacagacgtccccaaagcggccatttcagaggcctccccttagggatacattctctttctcagggatgctccttgctgggaaaaagaattcagtgatatttctcctatttgcttttgaaagaagagaaatatggctcagttccacccggcccacaggcagccagactttaagcttatctcccttgttccctgaacattgctgttatcctgttcttttttcaaggtgcccagatttcacattgtttaaacaatttgtgcagaaaacgcaatcatcacagggtcctgaggcgacattcatcctcagcttacaaagatgatgggattaagagattaaagtaaagacaggcataggaaatcacaagggtattgactggggaagtgataagtgtccatgaaatcttcataatttatgttcagagactgcagtaaagacaggtgtaagaaattacaaaagtattaatttggggaaccaataaatgtccatgaaatcttcacaatttatgttcttctgccatggctttagccggtccctccgttcagggtccctgacttcccgcaacacattacatcacagtggaaagtgagatagtaaaggaatattatgaagtactctatgctcaaagggggcatgatccctatgacaaagggatccattcttcgagaagacataacaggctgggcatggtggctcatacctgtaatcccaacatttggggaggccaaggcaggaggatcatttcagctcaggggttcgagaccagcctaggcagtgtagtgagatcccatctacaaaaaaaaatttaaattggcctggcatggttgtgcctgcctgtagtcccagtacttacgaggctgagctgggaggatcacttgagcttggagggtaaggctgcagtgagctgtggtcacaccactgcactccagcctgggtgacagagtaagactgtctcaaaaaaaggggaaaagacatgaaaattactatatttcactgaagatttatgaattgcaaataagcacatgaaaagatgttgaacatcattaggtattacggaaatgcaaactaaagttacacctgtcaacatggctaaaattaatagtgacaacaaatgctggtgagcatgtggaaaaacttgatcactcatccattgttggaatgtaaaatggtacagctttgtggaaaatactttgtcatcttgaaaaaaactgcacttgcagctaccataagacccagtagttgccctcttgggaattgcttccacaaaatcaaatgcttatgttcacacaaaaaatttaatatcagggcttaactgtaatcaccaaaaattgaaactagccctgatgtcctgagcagatgaatggttaaatcaacagtgcagcaaaaccatgaaatactcattagcaataaataaaaactaatgaagtaataatatacacaacaacttaaattaactccagataattattctgagtgaaaaaaaaatccagtaggttaggtaagcatgacattgacataacattgttgaaatcaggaaattacagaaatggaaaacagattggtggttagcatgggttaagaaagtggaatggtgaaagggaagtggtgtggccatacgtgagcaacacaaccccacttaggtagaatacacatcttctcaagtagacaaggaacattctccagggtacagcatatgctaggttgtaaatcaaaccttagtaaatgtaaaggatagaaataatacaaagtatttttaaaaacacaacggaatactattagatcaataacagaaagaaagtcgagaagttgggaaacccacaaaggtgtggaaatttaacagcacactctaaatgaccaatgggtcaaagaagaaatcaagagggaaattagaaaatactttgtgggccgggtgcagtggctcacgtctgtaatcccagcactttgggaggccgaggcgggtggatcacgaggtcaggagatcgagaccatcctggctaacacggtgaaactccatctctactaaaaatacaaaaaattagccgggcatggtggcgggcacctgtagtaccagctactcaggaggctgaggcaggagaatggcgtgaacccaggaggcagagcttgcagtgagccaagattgcaccactgcactccagcctgggtgacagagtgagactccatctcaaaagaaattttataaaaaaactttttaattaaaaattaaagaaatactattatatatagagaatgagggtttaaaaaaaaaagaagaaatactataaacaattgtagcttagatgaaatgaacaaggccgggtgtggtggctcacgcctataatcctagcactttgggaggccgaggcagatggattacctgaggtcaggagttcgagaccagcctggccaacatgatgaaactccgtgtctactaaaaaaaaaaaacaaaaaattagccagtcgtggtggcaggcgcctgtaatcctagctacttgagaggctgaggcaggagaatcacttgaacctgggaggcagaggttgtagtgagccaagatcacaccactgtactccagcctaggcaagaagaatgaaactctgtttaaaaagaaagaaagaaagaaagacagacagacagacggaaagaaatgaatgaacaaatttctagacagacacaagcttccataactgactcagaagaaacagacaatccaaatatgcctataataacaaataatgagattgctttagtaataaaaaaaaactacccaaaaaaactgcgggcccaaatggctttactattgaattccaccaaatattttttttaaataccaattcttcacaaactcctcaaagaaaaatagaaaaggagggaatacttcccaactcattcacggattctataaggcaacatcaccctgacaccaaaaccaaagacctaacaagaaaagaactctttagacaatatattttataaatgtggacccacgaaaaccctgaaaaatacaatgacatgtaaaagtattgtataccatagccaagtgggatttatctcaggaaggaacagatggttcagcataaaaagtcaattaggctgggtgcagtggtcacacctgtaaccccagccctttgggaggctgtggcaggaggatcacttgagcccaggagttcgagaccagcctgggcaacatggtgagacctcacctctacaaaaaaaatcacattagcttggcgtggtggcacaagcctgtagtctctgctgcttgagaggctgagcaggaggatcatttgagcccaggaggtcgaggcggcaactgagccatggttgcaccattgcactccagcccaggtgacagagcaagaccctgtctttaaaaaaaaaaatcagccagccacggtggctcatgcctgtattcccaacactttgggaggctgaggcgggtggatcacctgaggtcaggagtttgagaccagcctggtcaacatggtgaaaccccgtctctactaaaataaatacaaaattcagccgggcatggtggtgagtacctgtagttccagctacttgggaggctgagacaggagaattgcttgaacccaggaggcagaggatgcagtgagctgagatagcatcactgtactccagcctgagtgacagagcaagacaacatctcaaaaaaaaaatcaattaagtagaattagaagggaacttcttcaacctaataaaggacatctgtgaaaagcacacaattaaatataatacttaatggtgaaagactggatgctttcctcctgaaatcagtattaagacaaggatgcccactcttggcacttctattcaacattgtactaaagggtttggccacagcaattaggcaagaaaaaaaaaaggcatccaggtaggaaaagaagtaatactatctctattcacagatgacatgatcttatgtaaagaaaattctaaagagtccaaaaaaaactattagaactaataaatgagttcagcaagattgcaggatataagatcaatatacaaaaatcaatgtatttttatacacttgtaatgaaatggaagtgaaattttaaaaacacttccttagccaggtgtgatatgtggacttggtagtcccagctacttgggaggctgaggtaggaggattgctggagctcaggagttctagacgagcctggacaacatagcaagattccatcttttgaaaaaaccaaacagctccacttacaatagcatcaaaaagaataaaatacttgggaatgaattttacaaaagaactataaaacttatattctggaaacttcaaaacattgttggaagaaatgaaagaaaacctaactaaatggatagatgtttatgttcattgattggaagacctgatactgttaagatagcaatctcctcagattaatctatagatcatcacaacccctagaactgcagctgatttctttctagaaattgacaaattgaccctaaaatttataaggagactcaggggccccagaatagcaaaaacaaccttgaaaagaacaattacattggaggactcacacttccttatttcaaaactttctataaagcaacagtaatcaagacagtgtagcatagacatatttcaacacaatacaactgagagtccagaaacgacccaagtgtctctggtctcctgattttcaacaagggtgccaagaccattcaatggggtaaaaatagtctttcaacaaatgatgctgggacatctggatggacacacgcaaaataatgacattgaactcttcacataatatacaaaactttactcaaaatggatcagagtattcaatgtaaaagctaacattatgaaactcttaatagaaacataagggtgaatgtgtatgaacttggatgtggtagtggtttcttaaatatgagatcaacagtgtgagcaacaaaagaaaacatttgagatagggccttagtctgtcacccaggatggagtacagtggtgccatcacagttcactgcagactcaacttccggggctcaagtgatccccccagcttagcctccctagtagctgaaaccacaggtgtgtaccacgattctggctaattcttttattttttgtagagatggggtcccactatgttgtccaggctggtctcaaactcctgggctcaagtgatccacctgccacagcctcccaaagtgttgggattacaggcacgagccatggcacccagctgataaggaatattttttatgcagaatagataaaaactctcacaaactcaatgataaagacaatccaattgaaaagttggcaaaggatctgaaaaataagacacacaagtgactaatatgcacatgagaggttgagcaacatatcagtcactagggaaatacaaatcaaaaccactctgagatatcatgttatacccactaggatgcctttacttaaaacaacctgataggctgaatgtggtggctcacacctgtaatcccagcactttggttggccaaagcaggaggactgcttgagcccaggagttcaagatcagcctgggcaacagcgagacccccgtctccataaaaaagtataaatatacatacatacatacttggtaataggaaatgttggcaaagatgtggaaaaattggaaatctcatacactgctgatatgaatataaaatggagcagccacactggaaggcagaatggtagtttgttaaacagttagttatagagtgatcatacggctcagcaattccactcctaggtctatatattatatatccgagagaaatgaaaacacatttccacataaaaacttgtacgctgatgtttatagtaccattatgcataattgccaaaaggtggaaacaatccaaatgtccatcaacagatgaacaggtaagcaaaatgatgcatacaatggaatattatttggtcataaaaagaagtggaatagtgatacatgctacaacatggatgaaacttgaaaatattatgctaagtgaaagcagccagacaagagcaatattctgtgattcaatttatatgaaatgttctgaataagcaaatctatagagacggaaagcaggttgatggttgcctcagaatgatggggatcggggatagggcatgataaagtgtatggggtttcttactgaggtgatgaaaagattctaataatggctgtggttaaagtgtatggggtttcttactgaggtgatgaaaagattctaataatggctgtggtgatggctgcacatatgatgtgactacactgaaaatcattagattgtaaatcgcatgctgttaactatttcagtaaagccgtttttttttttttaagcaaaacatgagccatccttttctttttttttgagagtctcgctctgttgcccaggctggagtgcaatggcatggtctcggcgcactgcaacctctgcctcctgggttcaagtgattctcctgcctcagcctcccaagtagctgggattgcaggtgcgtgccgccatgcctggctaattttttgtatttttagtacagacagggtttcaccattttggccaggctggtctcgaactcctgacttcaagtaatccgccggtcttggcctcccaaagtgctgggattgcaggcgtgagccactgtgcctggccataatcttttcttttttgagatggaatcttgctctgtcacccaggctggagtccagtggcacaatctcagctcactgcaacctctgcttcccaggttcaagcgattctcctgcctcagccacctgagtagctaagactacaggcacctgccatcacacctggctaatttttttttttttttttttttttttgtagttttagtagaggcagggtttcaccatgttggccaggctggtctcgaactcctggcctcaagtgatccacctgccttggcctcctaaaagtgctgggattacaggcgtgagccattgcacctgtcctgagccatcctcctgaggaaaacgtactccatcttgagaaaaaccaacagacgtaggaatagagtacctaggttatagagcaagtatatgtttaattctatgaggaacgatcacactgtttatcaaagtaactattcttcctaccagcaatgcatgagagttccagttgctccacatcctcactaatacacattattgtctttttaaaaaatgtaagccattctaatagatatgtgttgttactgttatttcttttgctgtacagaagctttttagtttgtctaatttgtctacttttttgttgtatttgcttttgagtccttagtcataaattctttctttctttctttttatttttttattttttttgagacagagtctcactctttcgcccaggccggagtgcagtggcgctatcttggctcacttcaagctccgcctccctggttcacgccactctcctgcctcagcctcccgagtagctgggactacaggcacccaccactgcgccaggctaattttttgtatttttagtagggacggggtttcaccgtgttagccaggatggtctagatctcctgacctcatgatccgcccgcctcagcctcccaaagtgctgggattacaggcgtgagccaccgcgcccagctttttaaattttttttgagacagtctcgcactgtcacccaggctgaagtgcagtgacgcgatctcagctcactgcaacctgtctcctgggttcaagcgattctcatgcctcagcctcctgagtagctggaattacaggtgtgtaccaccatgactggctaattttttgtttttgaggcggagtttcactcttgttgcccaggctggaatgcagtggtgcaatcttggctcactgcaacctctgcctcccaggttcaagtgattctcctgcctcagcctcccaagtatctgggatgacagccatgtgccaccatgcctggctaattttgtattttagtagagaggaggttttactatgttggtcaggaaacagtgtgatcattttgggtcttgcttttattttttggtaggtggatctgaagcagtgctgccttagtctccttggactctcagctccatttcctcagctcaagtagtccactgggctctacctcagttctgcctcctcttgctgtggcctagaaattctctctggatatcagaaaacaaaggacagtaatccctgccaagatgggatacaaacaaggtgagccccatgattgcccaagcgtactacctggagtgtcttcttctgtttttttctttttcttttttttcttcaagatgggatcttcctgtgttgcccaggctggagtgcagtgccatgatcatggctaattgcagccttgaactcctggcctcaaatggtcctcccacctcagcctcccatgtagctaggtctccaagcgcatgctactgtgcccagcatggtatccagtgtcttgaaaccaccattgcatgtatttttgacgggctcctttggttgtttcaggtagaagggtcaacctggtccctgttactccatcttgtctgtaagttgaaggccttgatgttttctgcttatctcttcatcatctccaaacggtggtggtaaagtcactcacgactgctgtttccttcaagggaggaaacgtgcgaagactttgcccacacaatctcaatttgtcctcataacgttgcagatttttttttttttttttttttttgagacggagtcttgctctgttgccgaggctggagtgcagtggcgcgatcttggctcactgcaacctctgcctcccgggttcaagcaattctcctgcctcagcctcccgagtagctgggattacaggtgtgtgccaccacacccagctaatttttgtatttttagtagagacgggggtttcatcatgttggtcaggctggctcgaactcctgacctcgtgatctgcccaccttggcctcccagagtgctgggattataggtgtgagccactgtgcccgaccccagtgcagatttttttagtctcaatctctatttgacagctaaaaaactgaggcccagatgtttgctggtttggagcccagacaggcctgttggcatatattgcttcctggagctccacaaagctcgcaatgtcttgctgcatagttgctaagggagctgcctcacctgcacagcaagtctctggctcttcattccttaagagtcccacttgcagcctggctttttatgtgtacacacacacacactcacacaaactatcctggctttatttggcatgaacacatgcctgggtctcatccagccacttgacatccgagtgagacatggagtggaatggctgctaggccagagatcagtggtcagttaccccggcctctgactccaagtccaaggctccttctccaggctcagacccacacactgggtggtggtgacaaagatcaggacccaggagtgggtggtactcagccctcactgtgcttaaagattctgtgattctgtttcttctcctgtagatcaacgtctggatcactttctaataaaattccaactttgctgataattctccaatatacccaagactgtaaatactgatttcctttcatgaaattgtccaaacagctgcagcccttggtgcacagtatgatctggacctggggcacagcaagaccagaaccatgaaccaccatgaaccatgactcctcacttgtgagatgacgtgtgcaaggtgacctatggtgcttcatgaccacagaagtgaccactctacactgtgaaatgaatttctgcatggggggtatattagggttctctacagggacagaactaatagatatatatgaaagtttattaagtattaacttacacaatcacaaggtcccacaataggccatctgcaagctgaggagcaaggagagccagttcgagtcccaaaattgaagaacttgggagtccgatgtttgagggcaggaagcatccagcacgggagaaagatgtaggctgggaggctaagcaagtctcatctcttcacatttttctgcctgctttatattcgttggcagctgattagatggtgcccacctgattaagagtgggtctgccttccccagcctgactcaaatgttaatctcctttggcaacaccctcacagacacatccaggatcaatattgcatccttcaatccaatcaagttgacacgcagtattaaccatgacaggggggaatgagatgacacaaaggatcccttctggctctcatgttctgtcaccatctacttcaggagagagatgcactgtgtggggaggatgaaagttagaaggaaaaggcaagagaaatcaggagggtttggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctggcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggattttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattgaggacattcataccatcagacaacatcaccaccatccatccatctccagaggtcttcattgcaaaactgaactctacccattaaaccataattccctgttcccctcttcccccaagccctggcaaccaccattctaccttttctgtgattttaactattcttaagtacctcacagaagcggaatcatagtgtttgtctttttgtaagtggcttatttcactgagcataatcctcaaggttcatccatgttatatagcacgtatcaaatttccttttcatggctgaattaatgttccattgtacgtacgccacattttccttatccatctgttgatggacacttgggttaccttccgcattttactattgtgaataatgctgctatgaacacaggagtacaaatatcccttcaagactgtgctttcttttagatatacgcccagaagtggaactgctggatcatatggtgagtctatttttaattttttgaggaagtgccatatggctttccatggctgctgtaacattatatattcccaccaatagtgcccaaggattccaatttttctttgctgtttttttggagtcggagtctcactctgtcgcctaggctggaatgcagtggcatgatcttggctcactgcaaccaccacctcccgggttcaagcaattctcctgcctcagcctgccaagctgggactacaggcgtgtgctaccacgcccagctaatatttttttttgtatttttagtaaagatggagtttcgccatgttggccaggctggtcttgaattcctcacctcaggtgatctgcccgccttggcctcccaaagtgctggcattacatatgtgagctaccacacccagccaaggttccaatttttctacacccttatcacacttttttttttttttaatagtagccatcctaatgggtgtgaggtggtatctcactgtggttttgacttgcatttccctaatggtcagtgatgttgagcatctttttatgtgctttttggccatttgtatgtctattcaagtccttgtcttttttttttttttttttttgaaacagtctcaccctgttacccaggctagagtacagtggcgtaatctcggctcactgcaacctctgcctcccgggttcaaacaaatctcctgcctcagtctcccaagtagctgggattacaagtgcatgccaccacacctggctaatttttatatttttagtagagacggggtttcaccatgttggccaggctggtctcgaactgctgacctcaggtgatccgcctgcctcagcctcccaaagtgctgggattacaggcctaagccacagtgcccggccccttgcccatttttgaactttttttctcattgagttttaggagttctctataattctattaatctcttattagagatatgatttgcaaatattttctcccattctgtggattgcctttttattctgtcgatgtgtctttttttttttttaagagatagggtcttgctctgtcacccaggctagagtgcagtagtgcaatcatagctcactgtaacctcaaactcctgggctcaagcaattctcctgcctcagcctcctgagtagctaggactacagacaccaccatgcccagctaccttttttttttttaaacttgtagagatggggtcttgctatattgtccaagctggtcttgaactcctggcctcaagcaatccccttatgtcagcctcctgaaatgctgggattacagacatgatccacggtgcctggcctgatagtgtgttttttaaaaaattttttctataaggaatggaggcagggttttactatgttgcccaggatggtcttgaactcctgggctcaagtgatccttccacctcggcctccaatagtgctgggactacaggagtgagccaccatgcccggccaatagtcttctgatgtgaaatttagtgcctttaattttcatgaagtccaatttatctatttttttctttttaatgttgatgactttggtgtcatatccaagaaactactaccaaatccaacgttgtgaagatattccctatatttaattttaagctcttacaatttcggtcaattttgagttaacttgtatatgacgtttggtaagggtccaacttcactcttggatatccagtttccaggcatcaaccatttgttgaaaagactgtcctttccatagcctgggcgatcctcttacctcagccttccaagtagctgggactactgcttttttcaaaaaaaaaaaaaaacttcgttttaaaactcttatcagtcctggataaaaatgttgcctaaggattctaagtcctttggccccacctgagacaaatgctgaatggaaccacttttcatgacctccactgctgcctctgaggtccacgtcatcgtcagtttttgcctgttctattgcagtggccaactgatctaaccaccccatcccttctccacacagcagccagaggtctctagaaccaggtcaggtcaggtctttggctacctgccacccagagaatcgcatacccagattcctgatcacagctcacagcacccgctctggtcaaaacatggtgtcaggtccctttgcctttgtgggtccctttctctgcctgacaggagttgagcctcttcacccaggtctgggctcagacactgaggccttccccacctccccgcccaaggtaagtgtccagcacaggtgcttgatagcagtgtttttttttaaacagtaggtttcatctgttaggttgtaaaatcagtttggtaggtcatggccgacagtttgttttcaactttttattttgaagtaattatagattcacaggaggttgcataggaggttgtctagggaggtcctgggtacccttgccccagcctcccccaatgttaacaccttatacactacagcacagcatcaggacgcagaaattgacattggtacagtctacagaacatactcagtttccccagttacatctgtactcctttgtgtacctaactctacacaattttaacttcatgtatagccctgtgtaaccaccagtcaggctgacagatggttttcaacaccacaggactccctcgtatgaaccaccccctcaccatccctaacctaaacccctggtaacctttaatctgttttccatctctataattacattatttcaccaatgttacataaatggaatcctgctacatgtatgttttcaagattggctgtttttgctctgaagaatttccttgagtttcatctgagttgctgtgtgtacagcagttactgaaaatggcactatatcacatacagtacggatacatattgttttgtatttcaacaataatatgctatatataacagtctatgccagataataatgtaaaatacttattattaatatggggttttatccaaaacatttatttttatttttaaaacatttatttagagatggggtcttgctctgttgcccaggctggagtgcagtggcacgatcatagctgactgcaacctcaaactcctatcctcaagtgattcttctgcctcagcctcccaagtagctgagattacaggtgtgagccaccacacttagcacctgtccaaaaagtttgaaagatattgctcttattacagtatttgttttcttcataccaccaccataaaataccaaactgcttcagaaattaccaccattttatttttatttattttgagacaggatattgctctgtcacccaggttgaagtgcagtggggcacaatcatggctcactgcagcctcaaactcctgggctcaaacaatcctcctatctcagcctccgaagtagctggaactacaaatgcacgccaccatgcatagctcatttattttttgtagagatggggtcttgttacgttgcccaggctggtctcgaactcctgggctcaagcaatcctcccacctcagcctcccaaagtgctgggataacagccgtgagccaccacatccagccaccgttttaaattcctatttattgatgtttaatgtctgtcttttacccaaactacaacagaaactctttgaagacaacttgtctgtttcaaaactgtggtcttataagcctcaaaccctgtccaacatgtggacactcagatgttgtgaagcaattgacatagaaacaaatgcaggaacatcctgtccagagagattatctgttgatgtggaacttgagtagtgaaggaggaggcaaaacatgatagtcacactacagaggcaggacttaatgcttcctaacagagcatgcagccgcacaatgcataccttgctaaacaagcaggtggcagggagcgtggctgcactgaggggaagcccctcatggactggggtgctggctggcatgccctggcttttgctgcactctccagctctgccccaggaacctgaaggcagctgctgcaatcccaggcatcacatgcaggctgcaaactcattttattattttatctttgagacaagagtctcactctgtcgcccaggctggagtacagtggcacgatctcagctcactgcaacctctgcctctggggttcaagcaattctcctgtctcagcttcccgagtagctgggatcacaggcacgtgccaccatgcccagttaatttttgtatttttaatagagatggggggtttcaaccatgttggccaggctggtctcaaactccagacctcaagtgatccacccaccttggcctcccaaagtgctgggattacagcagactgcaaattcagatgccccgtccctgtgtttaagagtaagaaaaaccttgtagatctctagcagtcttcctctcttccctcactgggtggaaatgctcattattaaaccagccacagccatgctggaggcaccctggttgccttagacacatcagtactcccctgatgatgggggaacgctggctcctctttagatgctcctgctcttgggatcccgtgagcacaacccccacccccacccccactgttcacagacacaggggctcttagggagcacaggagaaaacacactcaagcagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatatggtggatctagggttgaatgacctccccagggaacgcaggcttgaagtggaggctgagaatgcaatccgagtacagccataggccggtcaaaggtatggaggcggtgtgtagcaggggtgagcggggtaggagtggcttggatgtctgtagttctattctaagggtgcgggagacatgtaacatttaccttattcatttttcgagacagggtcttgctgtgtcacccaggcttagtgcagtggcgtggcgtgttcatggcttactgcaacctcaaactcctggactccgaacagctgggaccaaaagcatgcacagcctcaccaggctaatttttaattttttttttttttttttgtaaagatggggtcttgctaagttacccaggctagtttggcctcaagcgaccctctcactttggcctcccaaagtgctaggattataggcggagcgccagtgcctggctgggacgtttataaaaaggagcaatgcacaagaggcaacaaaggcaagtaaagaggaggctggtgggcttgcagaaacgccctgcagtacctatgctgcggttctcccacttcactgataacaaatcctcagtatccactgatacaaatcctgggactgctgggccagtcccaggaatgacactgggacagactccctggaggtggatcagaaagctgcagttttaccaggggtcctgctgttgaggcagccggctcaaggaccaagcccaaataagacactgagaggaaggctgcaggccagggtgcaggagtaatgaccaggatcagtgctccaactggccccactgtgtcattaaaaggctctgcaatggaatccatcctggtccaggcaggggagtgtgcctccagcaaaggaccaggcgtttcactgcatacacagcaggtgttgcttagtgaagacaaaaacccagagccagaggtactgtaacattcttcattatgcataaagtgacagtctgttagctgatgtgatcctgcaaatgaaggctgtctacccaccaagggtttctccctctgctagtaaaactgagactttgtcagtggaggctcaggtaagtccccacagtgctcatgccttccaaaaccacgcccatttccagtgatgatggtttgtgccacaggccaagtactgaacatcatgacactcatagacactcttcactgaagacgtggatagaccctggggccaccattctctcctctctggagtgttggaggggccctgaccagggcaggacccccatgtctggaagcagggttagccctggctcatgggggaccctgctgggcttagccattgccacctagggatcaggcagccttgtttcttcctactttctccaggagaagccccagagggacacttttctaatggtgagatggaacacggagcacctgccaacaggccttcagttatggtcagaggcccaaccaccagtctgtgttagtacctaatcaaacatttagatttaggctttagttattgcctgtttttacttgaaattcttggcttagaattattcccaatggggccaggcacagtggctcatgggaacaaatttaaaataatcagattagcatgtcaaaagatctcacgttatagaaagtgaagatctaagaccaaataaatactgataaaaaatacaggccagcagaagcttggatgatttaataaattaaaattgggagttggggagtagggaagaaggagaggaacatctctttagcatttgttcattctaacattcacatgtttgcttctccatggagttgtttcactatgaacaggttcactaaggagccagttatgtccatatgaaatgagaataaaagtgcaaactcattcagatcaggttcttctgagtggtgtttttgaaaaaaatatgtaaaataaaaatagaaacattctttgtcaaatacttaaattgcagccacagtagtgggacagccactacttatagaacacatgtctatttaaagcctttttttaggccaaagactgacacctatgcaattgatgtaggaaaagaaaggataaatgaagaaaaagaaagaacacttcatgttagacaatttagtcaccttcataggttttgacagaattagggatgcagaattgctcctgctgaggcagtgggagctcccctcaagctgaaagcgtgaagaggtgaggaggcagctatctacaggccctcagggacagctctttgtctttccccaaatcaagcatacaactacaaagtcctgctgctccacttccaagtcaaacttaataattcttaggtaactctaaataaatcttaagtaacagagtattctctgatgaggctcgtccctgtcagtgccagtaactaaaagccaagatgttgcaaatgattcttttattattttccaatcagccaacagtcctcacttagggctttcttccctttttacgcaatgactgtccttctccagagaaagcgacgaatctgcctccagcttcatcctaggtttgaagagaagatactattttcagaaactccctggaggtttacaataaatgccttactctatggactcacgtaccatccacattactcataagaaatatctcaggctggacacgatagctgacacctgtaatcccagcactttaggaggcctaggtgggaggatcacttgagcccaggagttcaagaccagcctgggcaacatagtgagatcccatctctaccaaaaatagctcagtgtggtatgtgcctatgatcccagctacttgggaggctgagacgggaggatggtttgagccagggccatagtgagctatgattgtgccactgctccagcctggatggcagagcaacagagcaagaccctgcctcaaaaaaaaaaaaaaaaaaaaaagtctgtaagttcatcacccaaaaacatttcaggtcacttttctgtacatgcttaaagaattgttttcccacttaattctgaaatctcatgccaataaacttcctgtctagtatactcccaaggctacagaactgaattctgtaaaaaagaattccatgatgtaggagggccagttttctaccagtggacattgttgtggtaagcagcttaatgtatttgcacacaactctgattttttttagagctcaaattcctgggtcaaagtgtgtacacacttttaatgcttttaacatatagagaccaaccagccctcagaaacattccactaagctatccttccatcagcagaaagagggattgttttttcccaaacctttgaaaactgcacatattttttttcacatgcttttattgctagtcagtctgaggcattatctcaacttttccctaggaagaagaggattctggaatgttcaacacacatccctgcacctggctccccactaactgtagcatgttatacctgcaatagagcactgtttagtatttatgtggtcacattcatgtaaatttgagtcacagctgcatttagtcttcctttgccgcacagccttccattcatcctggtgtcaatagctgtgtttggcttcttcctctattcaatcacagcctgcattgcatggagttcatctgttttgacaaacctgtgtctcctgggccttcgccctgccgtacctggactggcctttctctaggtgccgtacatgttagtgggggctccttatttcctggattctatgactttcttatttctaccttattccttcattttagtgaggaacacctcctaggagcttcctgagaaaagatgcatgaggattatcttcttgtgagttccttttttctaatctcatatttcattgataggctggttggtatgttagtctgctagggctgccatataaaatgccaaagatagggtggctcaaacaacagaaatttattcttcatagttttggaggctagaagtgcaggatcaaggtgtcagcaggtttggtttcctctgacacccttttccttggcttgcagatggctgccttcttgctgtgtcctcacatggcccttcctatgtccaaatttcctcttcttaaaaggacaccagattgaattatggccaactctaatggtcttattttaacttaattgcttctttaaatggccctatctgagttactgggggttagggcttcaacacagaaacactggagggacacaatccagctcataagagttggtacagaattttaggttggaaaaaatttcccctcagaattttgagtatattgctccactatcttctagtttcctctgtgtcctgctaagatgatgtccctttttttgggagacagggacttactgttacccaggctggagtgcagtggtgtgatctcagctcacagcagcctccacctcccaggctcaagtgatgctcccaactcagcattaaagtagctgggactataggtgcgtgccaccatgcttggctaatttttaaaattttctgtagagacagggtctccctatattgcccaggctggtctcaaactcctgggctcagatgatcttcccgcatcagcctcccaaagtgttgggattacaggtgtgagccatggcgcttggctgatgatgtccttaatgcatggtgatacctctgttctctctctagaagctttaggatctttctttgcctcaaagtggggctattttcattcattttgctggaactcagtgagcccttcaaatctgcaaaattgtgcccatctttggggaaactatttccctgatgatttctgctcctttggtttctgtggctgttcttcccacaaatcctctattatttagatgctggaatggaaagctttctgactgtggccttcacttcagagatagtagtctagagacctactggagtcgagcctccagccttctgggatgggggagggagggtaatgcagctctaactgcttagtaacagaattctgtctttagtccctcatttctagaggtgccttttgagaattccacaatctacacagaactgcttctaggctttctatggtctactaaggtacctggggcttccaaagccttgtagttgcctcctcttccactgtctttcttacctcatgacctttagccacagccttagtggggctgcaggatggaatagagctaaatatgtcttcaatcccatctttaaacatatacttcttaaatacatatttatggtcaaacaggcctgctgtgcccactggcctcccctgccttctgtaaatttgcaacagtcaggtcacagtcagcctgggggacgtcccatgctaaggtcttaggtcggagtcaggcactggcttttagtgagaaaggcagcctgtagctggtgaagcctggatggtgcctgaaggaggagctggagggtgaggtctgactggccactatgtttgctcctctgagcctgaaaggtcccaatgcccaatgctgtttcaacttgaacattgagcccagaagtggttgtgagtaggaccaggtgtgcaaacttcacagtggtctctgtccccaaccaccccaagtgctagagaaaagagttcagtaattgggatggctcccatgtagcagctggtcctgaatgggtggctcagtacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccaccctgctcagctagaaggtgctgcctatatttgaagttcaaggtctctgttggaagacgaagcccacccagggcacacagttctgtgataacagagcctggagtcggctctagagcaagacagagctcctgacccccatgctgcaagtcttctgtttcatacaccctacaccagctctacagaaaaaaacaggacaccagggagcagagggaccctaggaaagggaaaacatgacagacaccctcatgtggtttggctgcgtccccacccaaatctcatcttgaattaccacgtgttgtgggagggaccaggtgggaggtaactgagtcggtgggaggtaactgagtcatgagggcgggtcttttccgtgctgttatcatgatagtgaataagtctcatgagatctgatggttttataagtaggtgtttccctgcaccagctttttctctgcctgctaccatccatgtaagatgtgacttgccccctgccatgattgtgaggcctccccagccatgtgaactgtaagtccattaaacctctttcttttgtaaattgcccagtctcgggtacatctttaccagcagcttggaaacagactaatgcacacccctactcagaatgccaagaacttcagtcatcactagcaaataaatctcctcattaccaaccaaggaaatacaaggaaatacactcacctcttcaacctttttgacaaggggacgtgaatttctgatgaaagttatcttaccaagtttaaattcataattgggaattcctctgtaagaagagacagagacagagaaatgttatttccaggaaaaaaggactaaaattcatttttgacagtcaagaggaacgcagaaaagatgctgctgcaccccacctgggccctttggtgcttcctggcatcctcccaggagggaagcagaaagtaactgacttcttggtttggtatcaatattgggtatagggccaggggctttaggctctgtacctgtctatggagaggggtcatctgaaggattgggaagccctcactgtcactgtcctgagcttcacagaaccccctgaggtggctagactctcactccagtattctgatttcacacacacaacagacaactgacacacctcagccctgcccctgccatcatggccaccagaggaagggtctgctgtgggtccccggacccagcaacagaagcacatctgaggtagctcctcagggaactttcaggggaactgagataatgtgacctgattaataattccaagtcacaaaacaggaaaataggcagatcaccaaatagggaccagaaaggttttgagtaagagacagatctaatcagactcgcatcttaggaaagccagtgggggcaagaagaggctgaattgggggtatggagaggtatggagagaggctggaccacagtggtactgggggtggcactgtggaaggaggggcatgttgtgctccaccccaccaaggagagcagctaagggttttagtcccttgggagactactgacccaggctttgtctccagaactggggtgaggctgcccgaccccagcgggctggcacagatcctcctcctgtcctggaggagagccaggacagacctaccttttaatatctccaggcttgattggggaggggctgggctctacccctttcttctttccatccagtctattgccagatccagagaaagcctagacaggaagtaggtgagtcatataataagcccaagtgtgaggacgatatgtcctttgcttggagatcactgcagggatgtgagctgggggtgctgtgcagaccccttcaggactgaagccctgactcctcaactgctggggtgctggcagctaagaactctgcccagttcctcagggggtggccatgagctgaagacagccacttggccaagggcagccagcagtcagtgttgggttaaaagacctgatccctgcctctgcagggccacccagttcaagctctatgggtgggctaaggctactgttgtgactgccccatagctcagcttcccatcattctgccctctctgctgcttcctggcacctcctgccacctcagtgcccacacatgaaccacctccacctgtttcccatggagccttgccagtagttatgctaagggtcatgtttgcaacctacatggtacaggcaaagaaaaaaggaaacatgatttacaagagagagaaagcaaatgtggtaacttttggtgaacctaagggaacagtatatgtctactgtactatttaaactcttcggtaggttagaaattcttaaaaatctgggctgccttatggggctgttgggaagattccaggagagagtggatacaaaagggtttggtaactgagcgagtggcagatttgcatatgcacaggtacccagaggcctaacccctgctgatgtccatcgagcatcatggagaacaccttgagtgagtgctctaatttcaaggagcagagggcacagcaatataagtcaagtggtctggtactcacgcggaagcccagctctccagcatagccactgtggtcggcttcaccttcctgacagggaaaaagaaaaacaggtgagctcctcagcggggacacccagcttccctctcacccccacccccggctaggatgtcccccggaagcatggctggaagggacgcagaggatatgactacaccaacactagcagaggccacccacgagccactgccaggaactcaaaagcagcatgcagcaggacagcaaaggacactgaggataacacttactgtcgactcctcatgctggacttgtctttcgggttctttgtagcccaggggagcatcaaagtccacctgtgtttccaggattttaaaagtaaaatattgagacatgaccacccttggcttccttttttgtttttaattgagacaactgtagattcacatgcagttttaagaaataatacaaaagatgccttgtacacttgcccagttttcccaacggtagcatcttacaaaattacagtaaagtattgctgccaggatatcaacactggcacaacccactgctcttattcagatttccccagttttacatgtttttgttcatgggtatctttagttctacacaatgtaatcactgtgtggggcatgtatccaccacagttgagatgtagaacagtttcaccaccactaggactgcccatgttgtctttttataaccatacccagctgtctcccagccccctccaccagtcctaagccctggcaaccactggtctgtcttccatttcgaaagttctgtcactttgaggatgttatataacgaagtaactttttgggattggctttttttgctcagcagtattccctagtaatacaaccaggatgctgtgtgcatcagcacttcattcctactcagaaggttcagtacgcttccttagctcttaagcatattcactcctcggccaggcgcggtggcccacacctgtaatctcagcactttgggaggccgaggcgggtggattacctgaggtcaggagtttgagaccagcttggccaacatggtaaaaccctgtctctaccaaaatacaaaactagccgggcctggtggcacatgcctgtaatcccagctactcgggaggctgaggcaggagaatcgcttgaacctgggaggtggaggttgtagtgagccaagatcgcaccactgcactccagcctgggcaacaggagtgaaactaagtctcaaaaaaaaaaagaatattcactcctcaacgggtcagagctaaccatggcagcactggcagcaaactctgttgccccaactggccctgagatagatcacaaggtcacagtctcctcatgatgttctgacagcatcttcctcctctttacccagagtcccaggggctgtttgatgccctcctgacaccctggcctgcagtggtcaccaactgcccatcctcccagggcccaggctcactgtaactggacagagccactcacgttcatgtcacactcaatgatggacactgccttgtcgggtttggtctccatcacacgcagttcgtagatctgtggggcaaacacagaaatcagttggatggtttcctggcagcactggagctgtcgctgtccatgttactgtggctctactggctcctgcgaatgacacagcattcatgcccatgacacaacctacagctgcacttcttgctgtgacaacactgccataagggacaggctgccctgtgcccatcgctgaagagatgctgttccccagatatggttcaaattagacaaggtagttatacagctaactgcaaaagacactaacaacctttaacctggaaagttcacttctggaactttactatttattttatttatttatttttagacagaatctcgctctatcgcccaggctggagtgcagtggtgcgatcttggctcactgcaacctccgcctccagggttcaagcacttctcctgcctcagcctccctagtagctgggactataggcatgtgccactacacctggctaatttttgtattgttgtagagatggggtttcaccatgttggccaggctggtctcgaactcctgacctcaggtgatccgcccacctcggccacacaaagaactgggattacagacataagccaccgcactcggccttcgaaatttattctaagtaaataactagctatacccaatgagaaaattctaagaatgctcataccaacgtcactaataccactgtacagatgctccttgacttatgatggaaccaagtcccataaacttataagttaaaaatgtattaatattcctaacctaccaaacatcatagtgcagcctgccttaaccattctcagaacacatacattagcctacagttgggcaaaatcatctactataaagcttattttataataaaatgttgaataactcatgtaatttattgaatactgtactgaagatcaaaaacagaatggttgtataggtattcaaagtatggtttttactgaatgtgtatcatgtttgcatcataataaagttgaaaaattctaggtagaaccatggtcagggactgtctgtatactcaaaatgcagctgaattatatttcttcatatgtaaatttacagttatacaatggtatgctacgcagccaacaggaaaataattgtaaaaccagtcatgttgcttgtgtctaagatgacctcacctatgtaaaaaaggcacataaaaaatgtccagaagcagggccgtgcgtggtggctcacgcctgtaatcccagcactttgggaggccgaggagggcagatcacgaggtcaggcaaatgagaccatccttgctaacatggtgaagacccgtctctactaaaaaatacaaaaaattagctgggagtggtggcaggtgcctgtagtcccagctattcgggaggctgaggcaggagaatggtgtgaacccaggaggtggagcttgcagtaagctgagatcgggccactgcactccagcctgggcaacagagcgagactctgtgtcaaaaacaaacaaacaaacaagcaaacaaacaaactccagaagcatagaaattaaaagtggccctatctactttttcctgcatcatttcaggttctttgcttttatctaaagtctgtcttgcttttttttttttttttttttcgagatggaggctcgctctggcacccaagctggagtgcaatggtatggtcttggctcactgcaacctccgcctcccgggttccagcgattctcttgcctcagcctcccaagtaactgggactacaggtgcgtgccaccacacccagctaatttttgtgtttttagtagagatggtgtttcactatgttggccaggctggtcttgaactcctgacgttgtgatccacccgcctcagcctcccaaagtgctgggattacaggcatgggccaccatgcccggccagtatgtcttgcttttacaaccattttaaaaagtctggatagtcccaccatttaaaaaaaaaacctaagcagggccaaatctacttttaaaagtgtcataattattgaatagataaggaataaaaaaaggatctgtcattgtgtggatatactaccacttatccactgagcatccggcctgtttccaatcattttgctgtgttaatgacactactataaacattcaaacatgtctcctagggcttggctcatgcttctctaccgttttcatgttttcaaaaggccacaaataatcagtgggtcataaaaccaacagggctgcaagcagaactgaaaaggaaagaattggaagacagtaccctagaagtactattgcatttagtaaggataaatattcctgtgacattttccatttacttttatgtattggcataatattaaatactttttttttaaactatgggaccaattttctaggttggtgctcctcaaactacctgggaagacctagtttttaaaaatgtgcagtctgctggactgccatgtggtcctcctgcacagaagcaagacacaacacacaccagacgcccagagctcaccaagacaagtactggttctgtggccatgtgtgtggaggttatgacaatgccaaattactatacgtttctaaacattcacttttgattcctgcttcctcgaggccctggcaaccaccattctttttttttttttttttcccttgaggcagggtcttgctcagtcccccaggctggagtgcagtgccttgaccctggctcactgcagactcaactgatcctcccgcctcagcctcctgaatagctgtaactaggcacatgccactacgcccagctaattttaaaattttttcattaattttttgtagtgacaggatcacactatgttacccaggctactctcaaactcctgggctcaaacaatcctccaaccttggcctcccaaagtgctgggatgccaggtgtgaaccacggtgtccaggtgattctactttctgtctcccatgagtttgactactctaagtactcatgtaagcggaatgtagtatttgtctgtctgcatctggtttatttcactgagcagaatgttcatccatgtggtagcatgtgtcagaattcccttcctttttaatgttgaataatattacattgtatgtgtgtaccacatattatttacccattcatctgcaatttatttttgactatggtatgagttaggaactcaatttgttttttcatcttaggaatagtcaatatcccagattccgcaaccccagtatctcctttgcctggtgacatcaatgctgcctcagtggtggaccaagattctttgtatataaagctttcttccactggcctacttgtctactccagaaccaatgccatatggtgtcttaactactggagctttattacactcagctgccgtatagaatcttccttatatatgaccagattcttttgtcaatattttatctacaatctatgtatctgtatcaagtgacaatgatctgtagtttacctttctcctatccttgtgtggttttggtgatcaaggttatgccgacctcagagaatgagttgggggatatgttctttctctatttttagaatatctaagagcaatttattgcttgagtgtgaggaagaacttgcatatataaccatctgggcctgtgtttcctggattaagatttttctgattgaattacttgactggctatacaattatttaggctgtttgtttttttttttctttagtcaaacttcaattacacttttctctaggaaataatttatcaatgtcaaataagttggctcatttcttagtataaaatttttcacagttttatctttcaagatatttgctttatctaattcattttatttgtttttaaacattcaatatgcatgtagacttttcagggtttgctttttttttgtttgaggcaaggtcttgctttatcacctaggctagagtgcagtggcacggtcactgttcactgcaacttctgcctcccggactcaagtgatcctcccacttcagcctcccaggtagctgggactacaggtgcatgccaccatgcccagctaatttttgtattttttgtcgagatggggttttgccatgttgcccagtctggtctcaaactcctggacttaagtgatccacccacctcagcctcccaaattgctgggattacaggtgtgagctaccacacccagcttcagctatcttttttattaactttattgaattgtaaacagagaacactttaattctaaacaactctctcaagagagtaagtctaggccaggcgcggtggctcacatctataatcccagcactttgggaggctgaggctgatggctcacctgaggtcaggagttcgagaccagcctggccaacatggtgaaacctcgtctctactaaaaatacaaaagtagccgcaagtggtggcacatgcctgtagtcccagctactcaggtggctgagatgagacaggagaattgctcgaacccaggaggtggtagctgcagtgagccaagatcgcgccactgcactccagccagggtgagacaaagagagactctctcaaaaaaaaagagagtaagtctaaagacttactcttttccaacattttagatgtcattttttaagcttcatacattaaacattattactgctttatatggcaacatttaccctggattcatatttgccaatttatttattccctattccttcttgctttccttctaggataatgcttattcctaaagtacatgcttttaaaattccattggtaaataacctctctcagatttggttcatctgaaaatattttcactttgcccttattctttaaggaaggttttgatgatagttacttgatactggctgtaactgttgctattcaaagacctgctacttgctgttcttctgaaggtactgtgttttctccctgcttacctctctgtatttggtattttctacctgtagcttattctgtttgttatacattataaatttcctgtcatgatgggctgaccaccaattctaaatcaatttcagttaccatctcttcagattattgcaattcctccattctttcctactgggattgcaatgggcatgtttgactttctcagtgtcttcaacatctcaagctctcatatgttccatccccttgctcctctgtgtgaaattctgttatttcttcagattcatctttcattaactcttttatagctgttgtttaacattgtttttcaaatctttctggttatttttgatagccttttgttgctcgctattataattccattttaaaaaatatctttgaacattttatatctaattattttacatttgtatctagaaattctaatgctgatttccttagggatctaatttttattgtctctgctttggtgtagtttaattatgtgttctttgcttgttcaattgacagcaatcccaaagacgtaactaaactggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtattactaccttaacattaaaaacaataacattaaactgcctgtaattaattataaaagcttagagtattcagttaaggtaaacgatacctaaaatgttctccacaaagctaaagggaacaagattatttcttagtttattaaaaggaaaaaagaaagtgtgattcgaaacccaaggaactgaaaaataaggtcagatgcctcaaatatgaggaaactgccagagaataagctggatccctgcactgacaccaagggagtaactggctaaaccacaggcagctgtgacacagctgtgacggcccagtccccgaagggaccagagagtgctgtgaaggagctaagtgctagcttcagggaaagcccagccaagccaggctgtggtcactcccgaacactaaggctagccctggcaacagctctgtgggagggtcaattgtcaacagtcacagtgaacaggggcacccatattactgtgctccatgcctgtggtgggacagcctgatggcaggattgccaactattacatcctcctgcaggcatattcccataggtaataggaaagtgaatgctttcttgaattttggactaagtcctgtcatttcactttacagttaaattgtctagatccagacacctaaacagcataaaatcagggatgaaaacagaggcattcagacctgagagacttgtgtcagaaaggtcaagcctagagaagctgctaagtgaaaacggaagctgaagaaaacaggaggtggaggaggatgtgggctcccaggaggagaggtgagcctaggaggtgttgccctaaggcagagccaggctttgcttctcagatgccacacagcacttggccccactgaagggcctgtcagcttctgtggggcaggtatcccaaggacaaggacccagcagggttgttattgtgtctccacagccctgcaaagggcttagctcagattagaggtgcagtggggacctttcaaaccaagacagaaccagcagccttgccaccaaggtacacagaggtatgactaataagtctatcaatgttcccctgtaaatgcaatctatcctcaaaacagagttaccaaatgaattagggctctaaatatgaacccgggaaaacttaataaccaaacagtaggcagtaattaggtgataagatccaggcatacgctgcttaaaaagaagccccattcaaacattagaatggacactgcaggtggctcttgtcaggaatgacctgcatgaactgggctcaccttttcattatagttgatggcaatcacatccccggtggtcagacaggcaaagttcctaagtgcgttttctaatctgcagacacattctgtcaaggcaacatggcaagatggataccttaatctgaaacaagtttccatgttagatgattactggtaggtagagactgtaccatgatggtacttgaaacacgaagcttttaatacaataaagtactacttggcaataaagaaggatggaactcctaatatgcaataatatggatgaaatgccaagctggggtaacaaatgccaagctgggggaaggggaaataaccaaccacaaaagggcagtgagattccatccacatggaaccctgagaaagacagatctatgaggatgggaggtagctgagaggtttctgggccaggggatcaggtggggactgacaggaaaggaccttttggggacatggaaatgttctgattacatgggtgtatacattttcaaactggctgaactgtgtgcattttattgtatacaaattataccatgggattttaaaaaatcctgtgggagtactaaagaacaaaaaagatttaatgagtcagataggtcctctcaaaagttcctcaaaatcaaagatgctttcatttatacttctgttgtttctatcttttgagctgataactttagttaatagaaattaaaataaagaaaccagcaaatactttttataacagtaaaactgtagaacccaaatgcccacacaaggaaatgtctattcatgtggaatattttgccatgtcttcctcatcaatttgctgaaggactttacataaaaaggtcacatgaaatgtggctccagagcctgccactgtgagtccaacttgagggtgaaagggtgaggctatctaggttcacctcgcttggtcaaacagctttccagaaccagagcaactttgtgaaaagcgccttatgtggtggatgctttctttgctcccaaatatgaagtgccacggtacgaagtgcccttccctccactcctctagtgaccctgccagggcatcttctctgacttccactgcagcagctggaggagcagagccagagccctcaggctgagaacacgaggcctctgcaggcagggcgggctccccatatggcctctgcgtactctggcacctgctgcagcaccagcttcccactttctctgctcggtgccaagactgctttcatccagacctcagccagaccagaaaacaccaggctctcaactgatggaagtgacgccctttctccacacactaacaagttaattgtgctgacaaaacagcatctgagatcaacctgataagtctgcattggggcagggcgcggtggctcatgcacgtaatcccagcactttgggaggctgaggcaggtggagcacctgaggtcaggagttcgagaccagcttaggcaacatggtgaaactccgtctctactaaaaatacaaaaattagccgggtgtggtggtgcacacctgtaatcccagctactcaggaggctgaggcaggagaatcacttgaatctgggaggcagagtttgcagtgagctgagaccgtgccactgcactccaacctgagcagcagagtgagactccgtctcaaaaaaaagtctgcattgcaacacatgtaaaaaccctgagaaaatgggcatggcccattcctggtcactgacagccaaacaagcatgtctaggtcagagctctgaaggacaagttaactagctcttcccataggacatccccctgcctgtgggacaggaggctcaacaaggccatcgtgtccagaacataggcagcaaagaatatacatggcccatatgcatccagagcacacccagcagtgccttgctcctaagaaaacatgcggagagagcgctactgggaaaggaggcagcttttcttaacttcctatctgtctgtgttgtttgactgtttgttttttttttcaagtatgcattaaaaaaaaataaaaaaaaagaagtagaatggagtggccactcttatgccatgatcgtaacaggaaaaatcagggccatggagctagagatcttgattggtgcacacagcaccgtcccgtacctgcactgcctacttcctgatgctgtcaacacatacacctggcttaagttcagaggtgaacaaaaagaatccactagaacctgatacctttgctttctgcttggtgacatagaaactgcagtcattgctacctattggcctggagtgaatcagctctcaggctggcatgcagtgaggttgacgggccagtgcacagctgggcggaggtactagggagccacagaaggggctggagctgaaggcagataagctgctccctccttccactggacatactgtgcatcctggctttgtgccaggtgacacagaccaactgaaagaagggcttcattgtggtctccatgaagtgtctggaaagtgacagaggtggcccagacagcacccagtgcacttggccagggccacgcagatgtgctagctgaaccccattattctcaaatcacaacttgaatcacaaatgtgtgatccccaaagcaggcacagattcaatacagtacatgatgtttaacaaccgccagcacactctcctttgtctagaagaactccgcttatttgaaaaagatacacggctttggggttggtgatgtccaggaagtcagggctctgaggttggaatttggagtaggtggccacttgaaggttgacgctctccacctggaccaggccgccttcttccaagagtaagttctgcatcatctgaaaggaagaagaggctacatgagactcctagagatgaagcagcctccacaaccactgctccctatacactgggcaggcccgtcttacttgggtccttggaagaggaacctgagccaagataagtaattcgtgatactatgtcaggaaggagggaaaaatcaagtgatgtggaaggaagaaggccaataaaggggtgctactgaagctgtatagctcacagtgtgaacgcatctctgcagggctgcccggattactcactagctccaggcttcccaggggcagagcattttcctggaatagtcactcactgtacttccaagctgtcccacaagcaaattataaggccctgcgtcaagtagggctgcacctgaggtaggacaaaagcagcacaaggcaaggctgacctggcaatggaatggcccaccacagctgaggctgcaagatggtgacagaccccagaggtctctgctaaggaggttataaaaatctgacaaagcctccacatgtctctattaaacaacccagccaggtagacgacggctgagaagtgagacggaaagagataaacaatgcccatgagtactgggtgtgcagggagtccagactcaggtcagaagctctatgtctcttgcaatgaaattttgcttgtcttatttgaaaccgtcttaaaaggggtgtcagacatatacatcagtagaaagagccgtagaagagagctcccacgcaccgagccctgacagttggacagtgctcacgtcgtggctcagtccatcgatcagcactacctcacacccagtcccaagccacattagatgccctgaagcaaatcccaggtatcacatcccttcaagaatgtttcatcgggagtggcagtgagaaggtgactttaacagccaagggaaaagggggctgagggctgtgtcacaaatgagagggagctcatgaggagggagaggcatgctgaggccgaggctgtgcctgggaagccgtgcctaggccatgagtgaagcctgagtggtgggccctatggataggcttgcagaggaccccatgcactcacgctgacagctgcttgtcaggctagtaagggcagaaatagagggtggtcactctaccaaatgccacaggcaggcacagaaggatgcagaggtgactggctttggtaacgggggtctggcatccccaggagtgatgttctaacaggaagtattctaaggctcagagttagccagtcgcaggccaggcgcactgtccctgggtagatttttgtgggaaatttgtcagcgaggggaaggatactgggctgcaattgcaagcctgagggaaggctggccagggatggggggtggcttcctcagccagaggcaggacactgccataggtgatgtgaggaggacaggcagagaggtcagactagggcttgaggtgagaaatgggctgctggaagaggcctgagagcactaagcaggcaggaggagctgatgcctggccctccccatgcagcattttagagcatacagcacaacgggcagccgagtacccacatgtcacaaacggctagtccagggctcggatctaggtcagcagacgaagccttggctacaaggaaaaaggccagtacctattccaggctggctcgccctgaagaagcttgggagcatgggtgggatggagtccaccagccagcccagaaaaagcactggctcacatgccctccaagacagcagatggggtatacctgtcacccgcctgcccatgccaggagctggaaggccagctcaggggaagaggtggcctgatggcttcacaccccaaaccagctccaggctacctaaagaggctttccaggggagaaagggttcaattagtttcctggtctaaagcagtccaacagcttggacaagaggccacccaaacttcaagtctatgggttaaaggagaaccttcgagatacagtgtatccccagcatcaccacctcctcttataggtgagccacagaagggactggggaagtagtcactgcctgacacttcagctacctagagtggcttcagtgaccaggtgttctaccggatgagcacaatgtggcctcaggcccttgggggcacctgcagacaaacacaagaatagcaaggggctgagcagcaaatactggggagggcaggtgagccaatctgggctttgaggcataaaagccccccaacaggccaggttgggcaggcctagtcagctgaggtgaggaggcagcatgggaaggccaggcactaggaggtgcaatgggagtgcagggctcttgtcggggagacactggccaggcccagaccttgggaaggaccctgggacccaggctgaagaggatgccactaccatggcagcatgggcaaggtcacctgctacagcaggaaagagaccttcagaattttgattcatattattgttgttttttttttttgagatggagtctcgctctgtcgcccaggctggaatgcaatggcatgatctcggctcactgcaacctaagcctcctgggtttaagccattctcttgcctcggtctcccaagtagctaggactacaggcacgtgccaccacacccggctagtctttgtatttttagtagagacggggtttcaccatgttggccaggctagtctcgaactcctgacctcaagtgatctgcccactttggccttccgaagtgctgggattagaggcgtgagccaccgtacctggccagaatttcaattcatatttaatctcagaaaatattagttaaggccatcccttctgaacgtctggcggccaccatgatagggcatcagcaggagaggtgggctgtgcttcagaccacctccctggtggcagccaagcaagcactcctgagagtttccagcccacagctcactgcggggtctctcagtatgcctgatgtaatccaagcacaaagagaaggacaagcaggtccctttgtgaacttccctaatgtgccagagctggggagaggagtgaggagaagaaggagccaagtgggccacagctacctgtgtggaactctcactgctgcaggctcctccctacagcactggcacagttctgctcacttctctgaggggtacagccttgagggcaggctctggtggctcacacgccctggatatcccagcccagatctgcaatgacatccttcaagtcaactttccaaagagagcctgcttgtaaggaaaaagacgtcactcccatggcagctcagttgagagatttgggagactacgtcagaggtaactgaaaacatgtatgctgtgacagactactaaaagtaggggaaaagcataaaaacctcaaacaccctacttactagaccacctaaaaaatactgttgctccattatttttaaaaacgcctcacccaggaaatcacagatgaacagttcagctgcgcaactatcaaagaaaaggccactcccacagcacagtggcccacaggtgcgtccagagcccaccagcccgcataaggcacagtgcactgctctggatcccttctctctcgctgggtcggctcaggctaagacgctgagcaggaggagtaggcggggccacctgctccagggccaggactctcgagtgcaggagatgtctctgcctaagtggctgctctctagagaccctggcagccccactcacccagtgtgggaggtagcagatgccctcatcagccacaaactccagcacgccacaatgcgtcatgcggtccgaattcttattggtcagtttgaacagcatgggataggtaatgttaagtcggcctgaaaataagagagagactatgaggcacagctcctatgaagggacacctgttcggcccacgccttcccatagaaggagcctccccacaatcctgccctcaaccccacactcctctggcagatgaatccccctctgtgagagcacagtgcacggctcaaggaggaacctggcaacttggtaacacagcactggcatagacttgtgattttctgaagtcaacattttaaaaagtgatgtgttcattcatttattcataaataatttcagtgcccaccatgccctggacaaaatcccgaccttcaaaggtttctagtttgaaggtagaaaccttccaacaaagaaaaccacaaccagatgctgcaggtgctgtgggaagagctggcaggagggggcagagctactgggctaggctcctagaggccgagttctttaggctgggcactgggcgggcagacctgggaggaaatccaggcagaggtggcagcctgagcaaaggcgtggaagggaagaggagcccaggcagttcagaaatggtggataattaggcaagacaggctggggacaggtgtgcgagtggttgggaaggggaggggcaccacacggggtagaacctagggcctgggcccagcgggcagtgtgagctctcagcagggtcatgacataggacgccccctctctctgatggaccttgaggtgtgggctgaaagcaaggccagaggcaagtaagctggactggtgacgtgctgacccaagaggtgcacaggcacataaaggaagggctggcaaaaagaggcaggaaaacccaggagacactgggcccccgggagaagaccgagaaggaactgatggtagtgatggtgtttgccatgtgtaaggcccttgttcagtcttcccagaacagtcaggtaggtactatcattatccccttttatctatggggaaactaaggcccacaggttaagtaacagcacacaagtggtgagcacacaagacctcacagcacacaagtggtgatgccaggattcaaaccaaggctgctggcttaagtccagggattcaaccatcaaagcagaatttagcttgttagttcagacaaatattccaataaaaatcacacttagtgttaggaagtaacgcagattccatttgagatctccctaaaaattctaataaagcaaatcaagttaaaagcttgggcaggaagctacagagaacctctgagagtagcatggaggtacagtaagggtgggcactccctcctatcaccaagggtgactctcacactggcagtaaaggggccaggacctctgtcccggtccacctctcagctgcacagccatggagctgacatacagctggtccacagtaaactggactgggctcagccaagggtctgagattgttgcaagtgaaagagactccaatgtccctcagtccactgactctcaaactgcattttgtgacttagaggctcccagtgccctggggctcccagtccctctgtaccccctcactttctccaaaaaaagcagagaacctcattttatgaattagaggacttcctataagatttagacagaaagagtttctcccatcacttaaaagatttgaacaacactgatctgagctacacctcaatgacccagcccctgagtctcttctggacacctgtgccaagggtcacccctggtgtctggctcctgggtcagcatgacttgaaaggaagacctttttagggagcctgttctctcctctgtaatgacagggtcttcgtgagaactgtgaactccatagctctgttgacctactggttgagctgaggcctccactgggtatagccacagccagtgctggctcaggggctacctccaccttgtggttggaatcggatagcttaggttgtcacagacactacagtacttctgatgcacagacactgtagatatccccaattaaagaagaggacattgaggttcagagaggtcaagttgctactctggagtcaggctgggcaaagagcccgaggtgagtcacaccacagccagcacctgttctctgcttgctgccaccagaggcccccaaaaccaagcatgaacctgtcctcctggccaaccccagtctcctgcctcacacaggaagaattcacaccagaaacactctttaagtctggaaggcaatgactgcatccttgattgggttgtccatgatagggattttctgtgcctgtgtagtatggggctagggcatgggtttccaggttgctctcatgggataaggggtcagagaaaagggaggaagaatgtggccactcttagaacccctgtgggcctatctcactcctggtaagaggcaggagcccagcaagaggagtggcttctggatggaagacaatagctcagtttttgacatgctgaggatgcattggtgcactggagattagaaacgggggtctgggccgggcatggtggttcacgcctataatcccataactttgggaggccgaggcaggcaggtcacctgaggtcaggagttcaagaccagcctgcccaacatggcggaaccccatctctactaaaaatacaaaaaattagccgggcgtggtggcgggtgcctgtaatcccagctactcgggaggctgaggcaggaggatcacttgaacctgggaggcagaggttgcagtgagccaagattgcgccactgcactccagcctgggcgctaagagcaaaactctgtctcaaaaaataaataaataaataaataaaagaaaagaaatgggggtctggagctcaggaaagatgtttggtgaggggatgaggaacctgctcacagcgccctcttgtgagctgaccaattcttcctttaggaaaaaaatctagtgagcccagccaatggcatcagctgccctggcacggtacaaagcacttgatacttgtaccttcacttaatcctgacagaatactgagaacagttggggggtgggtggaggtggtgatcaggaagggaaagggaacccccttcacagaggaggaacctgaagcacccagggcagtgatgaagctgaggttcagggggccctggcctcgccctaggtacctgtgacccaggttctcccagcccagcgcatgccctccacggacaattcacaaccagatgctgacaaagggcactggtgtctggatgtactgaggagcccatgctgactcttggtgtccatatgtacattatctaagtccttaagtcactcagaagatacttactgagttggtccagggccgagggtggcataattactgtggaaagaacatttaagaaatattaaaaaataaaaataaaaaggacagaccaaaggcaagatgcagtttctttatatctaacaaaaagccttaaactgtttttagggtagccagaatgtcccagtgatctttcatgaagaatcttacttgatgtaatttattttgggaactgaatggttatcagccataaacctaaccataattagcaccccaccccaacagagcaagtcagggataaatcccagcaccattttcacagtaacactagcttctgactcccacatgcaaagtaagtactgttgaaggctacagcattgcagacttagggcaggaaaagttactattcaaataaaaacaagcacatactcttccctcctttctccacatctgacctgtcattaggccctgctagcatggacacagagaagcagcggtactgtgtggagaagcggttttggaagaccctgggaatagggtggtcgaacatgttgaaagagaactagaaggaggaaagagaaacaagtattaaaacaaaggtacatttcttcatgtcaaaagccaaaacatgtcagagtaattaatgctactaaacattgtcagagaacacaatgtactgaaatcttcaatgtaatcttactaaatacaaaacaggccatgccaagcctgtcctgaacctttttcagggctatgctcccatcttcatcctcaggatcaaggcccaacctcttgcatacctcagagacttgtactgacagccccacagactcctgcctgggctagttcctctgccttgaacacttttcctattatcattaatctaaacaatatttgttaattgaaacatctctttattgagtgcctactgtctgccaggctctgatatgagcacaagggaagcaccactccagtgatgtctgtccactaacaaaatagataccacccctgtcctggtgaaaatgacactcaaagcaagagagatatacactccaagcaacggacacacacacatgtgtgtctggcagttctgaagacaagcagcagggtaagtagacacagggctcctgggaatgctattttaaataggtggttaggaagggactctgcacaaagacctgaatgctatgagagggagccaggcaaaaaagagggaaagacattccaggcagcaggaagaacaggtacccagtggttgcaccccttcccctgggttccaattaccatcctttcctttccccaggaagcctctcttgctctgctgagggtcaggtctagtgcctctccagcgtgctctcacagcacaaagtaggtacacgttacactatgttatgatgctttcttacagcaacaagcaaagctaaaacatgatgccattaaaaagataagatcctagatcttaaactgtagactaagatgaggcttagcaaacatgtatcaatttgaaggttttctcaaagtacagtattcctcccaccccccacccccatatccacaggggatacattccaacatccccagtggacgcctgaaaccacagataatactgaaatctatacatactatgttttttcttatacatatctacaattttcttatacatatctacaataaagtttaatttataggctgggtgcggtggctcacgcctataatcccagcactttgggaggcagaggcaggtggattacctgaggtcaggagtttgagaccagcctggccaacatagtgaaaccctctctctactaaaaatacaaaaattagccgggcgtggtggtacacgcctgtaatcccagctactcaggaggctgaggcagaagaatcgcttgaacccaggaggtggaagttgcagtgagccgagatcgtgccactgcactccagcctgggcaacagagcaagactccatctcaaaaaaaaaaaaaaaaaaaagtttaatttataaattaggcacagtaagagattaacaattaataataaaacaattacaacaatatactgtaataaaagttatgtgaatgtggtttctattttaatatttttggaccatggttgacctcgggtaactgaaaccacctaaaatctcacaggaggatatatattcaaaagaactggaggcagaatcaagaagagatttttgtacaccccgtattcatagcacaattattcataatagctaaaaggtggaagcaactcaagtgtccaatgacagatgaatgaataaacaaattgtggtatggtatatacatacaatgaaatattattcagcttttaaaaggaaagaaatcctgtcacatggatgaaccttgaggatatcatgccaagtgaagtaagtcagtcataaaaggacttatattttatgagtccgcttctaggaagtacctagagtaggcaaattcatggagacaaagtggaacagagattgacaggggctgtgaggagcagaaaatggagagctattgtttaatgtgagtagagtttcacttttgcaagatgaaaaagttctgaaaatctgttgctcgtgaatgtactcaacactattgaactatagactgaaaaacggttaagatgataaaaatttggtttttttaaccacaactaaaaaaaaatctgtattagagaaaatttcttgacttgattccaaatatatatttagtagaaggaatgccacctactgacaaagcagtttactagcaactccaaaattagcaagctgaattagccatctcccaaaatgcaaacatagcatgttcccgcctaaaatctgggatggttctttactccctggcactctaacacagtaatttccaatcttttgtctttcttcttttaagcagcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcgggggatgcccactacggattctccctggggagcgccctgattctgttcccatccccagcaaccttgcaactaactttgggtttatggaaacctgttgcgcgtccagcacttgggaaacccgtgaatggacacaaaccttcctttctttcgtcaaggagggcaagtccggctgagacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagtgccggacccgagacccggagggggggtgcccgggacaaagcgtcggctgcaaaagagaaaaggccaggcgaagacgctaggctctaaaacaccctcagtagaagcattaaaatgccctttcgtgatttatttccccttttataggtatttttaaacgttattttaaattacgtgttgacagtattcccctccagacgaatttagtagggcccattgtccttacgactacactacccacaatgcactacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggtaggtggggctggtcttggtgcagcccttggcaaagggcagtgggcacaaaagggtgagagctggactggaggctgggcccctcccctcacctctggtggtttgcacagcttcccgggacccttgagctgcctaccctggccatttgggaaaattcaaaggctgtgcagcttcctttccatgccctttctttcctttttttgagacagagtctcgctctgtcaccagactagagtgcagttggtgcgatctcggcacactgcaacctctgcctcccgagttcaagtggttctcctgtctcagcctcccgagtagctgggattacaggcacacaccaccacgcccagctaatttttgtatttttagtacagacgggtgtcaccacgttggccagaatggtcttgatgtcctgaccctgtgatccgcccacgtcggccttccaaagtgctgggattacaggcgtgagccaccgtgcccagccccgtgcctgtcctttcttaggaaaaggctttcttaggaatgccctcccaggcagccttgggcctcagcttctgaccaaacacaccagacctggtactacccagtcccggtggccaggtgcaagagtgtaaggaccattgtttttggctctgcccagggccacagctctgggatcacacactcccaagcttggggactattcttggtccctgttgtacaggcccaggtggggtacaggtcaggcctgctgaggacctctgcaccgtggggcccctctccctgtaactcatcccaccggctggttccacagcagctcccaggaagctgccacacattccagcagctgccctaagccactctgagcctgcattcttggggttctcccactgctccatgatggtagcctggccagacctaggagactccctgccactggatgtggcccagacatttctgggcagggcccccaagtccagtttggggcagataccaagtctcccttccggctgggcttagagctcttccctgcagcatgcccccttcatcagctgctctcttctgcttctagctttatgtcaaatgtcaaaaatgtgttaattcaaagtgcctagaacaaggctaaaaacagtgagctctcagtggctatgttagatggctctagacacccccattccgaggtgcctggcaggggccagcactgactcccaggccacacagcccctggaggaggaaggttacccagagtgcccccagcaggggctggcacaggtgctggttgtgagcaccattctgggcaggctgccaggccagcagggtgggtacaggctctgtagggagctgcgctgggactggcagaggagccaggacgaggggctagagccaagctgtggtactccaggcaaccagctgccagcacctcctcccatggcaaccctactgttgaccggcgtgtcctgcattcacccctgttcctgccccacccaccattggaaagggcctggtcggggattctacagacctctgtggccacttgatggggcttgggactaggcaagccctgagagggcagtggaaaacctcaccctgtgctgtgtggggcttggccctttctgggagaagccagcggcctggctgctcacccccagcacttcccacaccgcaggacccccactcaccagcctgtgttgagggcgcttcaccccgcatcttctgctggggtctgccgctgcccccgcccctgtcccatcccgggccccagggccccatgacgcagcagctcttctgaccgcagatcccgcctttctgggctgtagtaagtggtggctgtgtctcccacctggtgggaaggtggcagggaggatggggaaaagagccccagcctccagccctgggaggaggtctccacaggagtccttgggagggcggggctggtgggtgatgaatggggctgctggacacggaagatggctggacagagaacaggacacaggtgggagagagttcaaaccatttactaagcagattcttagccttcccactcccgccctctctcaagctccggtgcccacaagccttgcctggggagatgctggagtgagaccgggaggtccaggccaagtcactggtccctgggctcgggccctgccgatggagtaaagaccagctgtacacatcttccggtgggggccctgggctctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaagccccacccaggccctttctcgcactctcactctccagccccgctctgagtcccagcactgtctctctcatcccatggcaaacagagaggccaggcaggcgtgtggaggtcaggcccagggccccagcctcaccccccatgccactcactgcctctctggagcctgagtctctggcaaaaagcggtggcacaggggctttccccctgcctggcgacccccactctcccaagccgcaggggcttcccagacctctcaatcttcacaggggctgctcctcttcctgcggtactgcccgcaccccatccttgggggcccagttcaggtgacaccacttcaggaagttcccagtgacccagcacactgggtgtagcacccaggggcagtggtggccccaggcctagcagcctgctctggccttcagacaggagagacaaagggacacggaggggctgtgccctgccctcccaccagtggcgatggtgtccctggcaccccagcccccaggccaccctccggaagccaacttggagtttcctggccaggaggaagagcccccatccttgctggaggagggaggcgcgggatttccgggcattcttctgcacaatggcccagccatttctcgaaaggtccactggtgtggacactccgggccccctgaggctcaggtgggggcacgcggctccaaaacccacagccccatgggggcaccagcccctttctagtagttctttccccagtctctctcggcccctttgtttccagtaaagtttgaactccaggccctggactgaggccactgggtgcccagttcttttatctggtctgtgctcagttccattggacagggccctccatagaaaaagtatggcactgaggctggtcacagatgtgggaggtttgatgactttctccctcctggggcccggttcccttctcccccttcagatggctctgagatggtaaatgagataaggccagcgtctggctcacctagtgtggggaggttctgaaggcaagtgtgcccagccctgaggctggaaggaaatcataccctctttgctcagccccacgtggcctctccccaccaggtatggctctgaggaccactgccttctcccagctatcactttagtcactgccttcctcctgctgcagacccatgggccatgccccttcctctacagaccctcctggacatctcctcctctgtgtactccaggggtacagctgacccacccaccctctcactcttactaccccctaacccaagcccagggaacttccccagatccccctactcccagcccttccatgccaccatcttcctgggatgactgctgcggcctcctcaggtcatcagggacctgcccttgcccagctaggccacccaccccaccaggcccctctcctgggcctcaccctacctaagaccctccatggctcacattgcccatggacgaagagccgactcccagagcagctggattgatgtgtacctgcatgcgctaggactggccagtccagccaccagtcttggtgcggccctgagcacacactctgccccaggagacttacctgcctatgggcctcacatgggccgtctcttaccttggcctcttctgcccgcagcgtgtatctgtcaggttgggtcctgctcatcttctaagatgtgttgccgaggtcatttccaggaacaccttgctgcaccgtcccccagcattgcttttagaagcttgagctggacctgtccttttgcttgccgactttcccacctagtatccaggaataacctccacagggtggctgtcttcatgcgtctgtcctgcacaggaggctgcctgttgccctctagccagcttggagctgcagccagcccaaggctctcccttctcacctggctgcctgtttttcttctctcctagctgtcaccctagggtggccccagcaagctcatgtttctttggcggcagcctcacagcatctcagggacgtggcagaggagtctcaggcttcacctttcacaatctggtttctaccctgaccccactatgttggtcgaggccccaggctgcagtggaacaatgccaatgcagagaggcccagagagggccgcaggggctgacgccaccccagacaaacccacctcagatggaggctggcctctgagtagcccaggccagactccggaggggcatgagggtgcacccacctttcctgccactcatggagggtctgctcacctacttcgtggcaagcactgtctctaggcagagcacacagcacaagaagctcctgcccagaaggagctgacaggaacctatcaaccaagaactgggcaggaaagacagtggtgaaggcctctctgaagaggtgacatttcacagggatccggggaagaagttccaggcagagcagaagcaatagccagtgcaagatcccagaggtgggaaggggctcggcgtccaaggggcagaagcggccttgtgtccacagtgccacagtggtccagggcctgcaggtggagatcggaggtgtcctggttaggcagggacacaaacccctgatctctggtaaagggcccttggggcagagcactggccaaggccacctgctcacccccagccattgttctgctttcccaggggaagaatggcaggatctcattaattgtgtgtgagaagagcctgagtctgcagaaaagccaagtttatcttgagcagctgctggctgaccctgccccagggtaatcccgtgaccttccaaggataagctaaatttaggctcaagattcctggggatttgggtttgggaaactcctagttaacagatttgatttcaggggaagtgaagaacagcgtttcttctatctttcagttttgaaacagttaaggatgtgtccttctatttccgcaaatgtttgcagagcctccaagcacagtgtggcctggtgctctttcttgacacaagccagtactcctgcaggccgagagcagcagctggggtcctcctgcatccctgaccactgcaccaggtgcccgaggcaccctgtgtggggcccctgggcggctgtgacgatgtgagcagcatccagagtggacagtgccagactcggcggttttgcgggcattgttgttactctttgtggttaaacacaggcatggagtcagattcgctcccgcaagcaagaaactttctggactagtgaggtggcctctctgccttagttcctcactggtaacgaagccccccaatggtggaggctgcgaggctgcaggggaggccgatgccagtcccggttctcttctgcctttcctgagtgccatccacccaggctcccagggccttcacagctcatccaacctcagccgcacccctcagggtagtcatcgctggctgttagtcagaattggaggtcactgtggctttaacttccccagcgggtgagggagtggggggcagggagctctggtgtgatccacgaagggtcaagggttctatagaatggcaagccaggccaagcgcagtggctcacgcctgtaattccattcaggaggccgaggtgggcggatcacttgaggtcaggagtttgagaccagcctgtccaacacggtgaaaccccgtctctactaaaaatactaaaattagctgggcgtggtggcacgcacctgtaatccgttactcgggtagctgaggtgggagaatcccttgaacctgggaggcagaggttgcagtgagccgagatcatgccattgcactccatcctgggcaacacagcaagactccatctcaaaaaaaaaaaaaagtccaccaaagtacatcataaaccaaatttcgtaaaactggtgctaaagagaaagtcttaaaagcatggagaggaaaggccgggcgcagtggctcaggcctgtaatcccagcactttgggaggccgaggcgggcggatcacctcaggtcaggagttcgagaccagcctgaccaacatggagaaaccccgtctctactaaaaacacaaaaaatcagccgggggcttggtggcaggcgcctgtaatcccacctactcaggaggctgaggcaggagaatggcgtgaacccaggaggcggagcttggagtgagccgagattgtgtcactgcactccaacctgggcaacagagtgagactccgtctaaaaaacaaaacaaaaaaaagcatggagaggaaaaagacacattgtgtgcagaggaatcaagaagaaggagatttcttgttggaaacagtgcaagcaagaagatagtgtagcaatatctttaaagtactgcaagaaaaaaatccctgtaacctaaaattctttttcttttttctttttagaccgggtttcactttgtcatcgaggctgcagtgcagcggcacaaacatggttcactgcagcctcagcctccgggttcaagggatcctcccgcttcagccgcccaagcacccaaatagctaggactacaggcgtgcgccaccacacccggctaatttattttattttatttttgttttttaaattttttgtagcgatggggtttcaccatgttgtgcaggctggtctcaaactcctgagctcaagtgatccatttgccaatcccagtgctcggattacagcgtgagccaccacgcccagccttaacctaaattctatactcaccaaaaatgtattccaaaaatgaaggcaataccacatccatggatgagcctgaaaaaaataaatgaaggcagctgggtatggtggctcacgcctgtcatcccagcactttgggaggctgagacaggtggatcacctgaggtcaggagtttgagaccaacctggccaacatggtgaaaccctgtctctactaaaaatacaaaaattagctatgtatggtagcaggtgcctgtaattccagctacttgagaggctgaggcaggagaatcgcttgaacccaggagacggaggttgcagtgagctgagattgcaccactgcactccagctggcatgacagggcgagactccatctcagaaaacaaaaacaaaaaaaatgtttttaaataaagacaaaacagacttctgcttcctagaagacagataaacatatgtttccctattccttccacaaaaaaaccctaaatgttataaataaagcaaacataagaagatgctaagtgttacaaagaaggcagacaagctagagacttagagccaaggacgaaatggtggtgtttctctgggttgcctttttgtttttttttttcttattttatttatttattttagaaatagttctcattctgtcacccaggctggagtgcagggacacaaccatagctcactgcaactttgaactcctaggctcaagtgattctcccacctcagcctcccaagtagctgggactacaggtatgcaccaccacccacctaatacttttaaaaaatttttgtagagacggtcttgcaatgttgctcaggctgatcttataactcctggtctcaagggatcctcctgcctcagcctcccaaagcactgggatgacaggcatgagccaccatgcccagcctcctgggttatctttttgactcatgtatcccagactgcatacagaggagctggccacccagaaacaccaatgggtacaggcaaaaaataagtcctaagcaaagccggttctgtctagccaaaagatcaggacaaagacagactaacaagacaaaaatattttagacaataaccactctactcaagctatactactacagaaaaaaactgtggccccaaccctgccctcaatagcaaagaccagtggggagcttagactcctacccttgccaggctgtaatgagatgctccagcctcctactggggtgtcagaggaggccaaggaagacttgggtggaaataggtccccctccctgaccacagtgtcagtggagaccacatggggagcctggacttccactcctaatgtggtaataagggccccctccaggtcctcactatggtactgtcagaggaacctagcagagggtaaggacattcttcattttccagaggtgatgaggctctccctgcccacacatggtgccagtggaggccacgtggggatcagcagcaggcattcctcccatccatgcctggggtatcacaagaggccgagtggggagcaggaactcccagccccacccagcagtcacaaggatccccgtggccccaggtgtcaatggaggtagggtggagaacctggacttccacttctgcctggcagtaaagtgtcccctgtcattgccagaatggtgtcagaggaagcttgctaaaatacaagatttaaataagatccacagtcttgtaataaccaaattatccaagttttgattgaaaataagtcatcaggctgggcggggtgtctcacgcctgtaacccagcactttgggaggctgaggccggcagatcatgaggtcaggagattgagaccatcctggccaacatggtgaaatgccatctctactaaaaatccaaaaaaattagccaggcatggtggcacacgcctctagtccccgctactcaggaagctgaggcaggagaattgcttgaacctgggaggcagaggctgcagtaagccgagatcatgccactgcactccagcctgggcaacagatcaagaccctatctcaaaaaaaaaaaaaaaaaaaaaaagaaaagtcatcataccaagtatcagtaagatattaaactaaattggccaggtacaatggctcatgcctgtaatcccagcactttgggaggctgtgggcagatcgcttgaggtcaggtgttcgagaccagcctggccaatatggtgaaaccctgtctctacaaaaaattagccaggcttggtggtgcacccctgtagtcccagctactccagaggctgaggcatgagattagcttgagcctgggaggcggaggttgccgtgagctgagatcgtgctactgcactcctcctgggcaacagagcaagaccccgcctcaaaaaaaaaaaaaaagaaagaaagaaagaaaatcgacaaagatggcaatgtcacagatgtgagaattacttcatatttcaaagcagaaatgataaaaatgcttcagtgagcaattacagatatgcttgaaacaaatgaaaatatagaaagtcttacaaagaaataagaaccacatagaaattttagaactaggccagccatggtggctcatgcctgtaatcctagcactttgggaggccgaggtagatgcattgcctgagctcaggagttcgagaccaacctgggaaacatggtgaaaccctgtctctactaaaatacaaaaaaattagctgggcgtggcggcgtgcacctgtaatcccagctactcaggaggctgagagaggagaatttccagaacccaggaggcagagattgcagtgagctgagatcgtgccactgtactccagcctgggtgacacagcgagactctgtctctgaaaaaaaaaaaaaaatttagaactaaaatacagtaaccaaaattaaaaaaaaaaaaaaaggtcattggggctgggcgtggtggctcacgcctgtaatcccagtactttgggaggccgaggcgggcggatcacgaggtcaggatcctggctaacaaggtgaaaccccgtctctactaaaaatacaaaaaaattagctgggggtggtggagggcacctgtagtcccagctactcaggaggctgaggcaggagaatggcgtgaacctgggaggtggagcttgcagtgagccaagattgcgccactgcactccagcctgggcgacagagcaagactccgtctcaaaaaataataataataaaaaggtcattggatatcagctggacagcaacatggaagggacataggaaactattggtgaattggaagctagaacagtgcaattttcccatctgggccagccacagtggctcacacctgtaatcctagcagtttgggaggctgaggcaggaggattgcttgaggccaggagttaaagaccaactggccaacacagtgagacgtgtctctattaaaaacaaaattttaacccaattatcccatctgaacaagagagagaaaatcactgaaaaaataagaataaacaaaggctcagaaaatgtgagatcataacaaaagacctaacatccatgtcatgagagtgccaaaaggagaggagaaagggggtggggttaacaaagcattcaaagaaataatagctggaaatttcctgaatttagcaaaaagaaaaagagagagaaaaaaaccctacagattcaagaagttaagtgaggccgggtgcggtggttcacacctttgggggccaagatgggtggaccgcttgagcccaggagttcaagaccaacctgggcaacacagtgagacccctgtcgagagagagagaggagaaaaattaaatggaaccttaaacatgataaactcaaagaaatccacactaaaacatctttttttttggagacagattattgctgtgtcgcccaggttggagtgcagtggcacgatctcggctcactccaacctctgcctcctgggttcaagagattcttctgcctcaacctcccaagtagctgggactacaagcacatgctgccatgtccagctcattttttttgtatttcagtagagacagggtttcaccgtattgcccaggctgatcttgaactcctgagctcaggtgatctggcctcctcagcctcccaaagtgctaggattacaggcggcagccaccgctccaggcccaaaacatcttaattgaacttctgaaacctaaagacaatgcagctagacagaaaaatgacacctcacctattggagaagaaaatgaatcaaatgacagagaatttctcttcagaaaccagggagaccagaagaaagtagcacattttttaagtgctgaaagaaaaaaaaaaaaatctcaatccagaattctatgtctagtgagcatattattcaagaatgaagggggaaaatttttttttcaagtgaaggaaaatgaagagaatttattgccagcaatatatgctgaaagaatgctaaaggatgttccttaaacagaaaggaaatggtaaaataagagtcttggaacatcaggaaggaagaaagaacatgataagcaaaatactggtaaatattaatacaatagattttcttcctcctcttgagtttcctaaattatgtttgatggctgaagcaaaaattattacactgccttaagtggttctcaatgtatgtagaggaaatatctaagatatataattatattataaatgggggagggtaacaagacattaagggaggtaaggttttttgtttgtttgtttgttcgtttttgagatggagtctggctctgtcatccaggctggagtacagtggcaagatctcggctcactgcaacctctgcctcccgggttcaagtgattctcctgcctcagcctcccaagtagctgggactacaggcgcccgccaccaggcctggctaatttttgtatttttagtagagacagggtttcaccacattggccaggctagtctcaaactcctgacctcaggttatccgcctgcctcagtctcccaaagtgctgggattacaggcatgagccaccatgcgcagctgggaggtaaggtttttttttttgttttttgtttgtttgtttgtttgtttgtttttgagatggagtcttgctctgttgcccaggctggagtgcagtggcgcaatctcggctctctgcaagctccacctctgggttcacgccattctcctgcctcagcctcccgagtagctgagactacaggcggctgccaccaagcctggctaattttttttgtatttttagtagagatggggtttcaccgtgttagccaggatggtctcaatctcctgacctcatgatccacccaccttggcctcccaaagtgctgggattacaggcatgagccaccatgcccggccaccgggagataaggttttttacacttcattccaactggtaaaatgttgacacctggagactttgattatataatataaattttatatatatttatcctacagcaaccactaaaaagctatacaaaggtatcaagaagaaaaaaaaaataacaaatgctggtgaggttgcagagaaaagagaactcttatacactcttggtgggaaagtgcacccatctggtaccataaactagcccaaccacaatagagaacagcacggagggtcctcataaaaactgcacatagaaataccataccatctagcaactccatgactgggcattaatccaaaggaaggaagtccgtttatcaaagacacatctgcacccttatgtttaccgcagcactgttcactagccaagacatggaatcaacctaggtgttcaacagcagaggaatggataaagaaaagttggtacatatacacaatgaatactattcagccattaaaaaaaaaaaaaagaaatcctgtcattcatggcaacataaatggaactggagaacaatatgttaagtgaaacgagccaggaacagaaaggttatttatttatttatttttcacttatttatttatttattgagacagagtcttgctctgttgcccgggctggagtgcaatggcatgatcttggctcactgcaacttctgcctcctgggttcaagcaattctcccacctcagcctctcaagaagctgggattacaggagcgtgccaccatgcctggctaatttttgcattttgagtagtgacggggtttcaccgtgttagccaggttggtctcaaactccttacctcatgatctgcccgcctcagcctcccaaagtgctgggattataggcatgagccactgtgcccggctgatgttttattttttagagatggggtctcacaatgttgcccaggctggtctcaaacttctgggttcaagtgatcctcctgcctcaccctcccaaagtgctgggatttcagggaggagccaccacacacagctaagacagagttaaacaccacatattcttattcatatgtagcagcttaaaaaagttgatcttggctgggtgcagtggctcatgcctgtaatcccagcactttgggaggccgagggcgggtggatcacgaggtcaggagatcgagaccatcctggctaacacggtgaaactccatctctactaaaaatacaaaaaataataataataataattagccaggtgtggtggcgggcacctgtagtcccagctactcgggaggctgaggcaggagaatggtgtgaacctgggaggcggagcttgcagtgagccaagattgcgccactgcactccagcctgggcaacagagcgagactccgtctcaaaaaacaaaccaaaaaaaagataaataaaaaataaaaataagtaataaaaataaaaaacaataaaaattaaaaattaaaaagtatatttaaaaagaggtagagctatatgcactgacctggacatatctctaacagatcttattaagggaaaaaaatcattcaagtttatcacattacatatacaatgatactgtgtaaacttaaattcccacaaaaatgaaactatgtaattttttttgttttgtttcattttgttgttgttttttagtgagacagagtctcactctgttacccaggctggagtgcagtggcatgaacatggctcactgcagcctctacttcccgggttcaagcaatcctcccacttcagcctcacaaggagctgggaccacaagtgtgcaccaccacgcctgcctaatttttgtatttttctgtagagagggggttttgccatgttgcctaggctggtctcaaactcttaggctcaagcaatcctctgcctcggcctcctaaagtgctgggattacaggtgtgagccacctggccaaaactatgcacttttttttttttttttttttttttttttgagaaagagtctcgttctgtcgccaagctggagtgcagtggcaggatctcaattcactgcaagctccgcctcccgggttcaagcgattctacctcggcctcctgagtagctgggactacaggcgtgtgccaccacacccagctaacttttgtatttttagtagagatggggtttcaccatgtttgccaggctggtctcgaactcctgaccttatgatccacccacctgagcctcccaaagtgctgggattacaggcgtgagccaccgtgcccagccccaactatgtacttttatgtttatttttatgaatacaaatggacagataaaagtctaaggcatagatgccaaattgatatctattattgcctatgtgtaggagactctgggatttactgggggagacatcagggattttttactttctttgtattctgtactttttctatatttcacgactttctatattgtttgaaagtttacaacataaatgtatttacatcttacctacaaaattattatttctttaatgaacagttgtagcttatatataattccttcagaataaataaataaaagaaaggaagaacacgggggaaaagctatacaaagagacacactcaaaaacactgtagataactcaaaatgtaattttttttttttttttttgagacggggtctcactctgttgccgcccaggctggagtgccgtggcgcaatctcggctcactgcaacctccgcctcccaggttaatgacattctcctgcctcagcctcccaagtagctgggattacaggcaccccccaccatgcccggctcattttttgtatttttagtagagatgggatttcactgtgttagccaagatggtctcgatctcctgaccttgtgatccgcccgcctcggcctcccaaagtgctggaattaacaagtgtgagctacggtggccggcctcaaaatgtaattttaaggaatattcaagtaagccacaggaaagcagggaaaagtaaagagaaatgaacaaaaagagacacaacaaacaaaaaaataaaaataaaatagcactcttgggccaggcgcggtggttcatgcctataatctgagcactttgggaggtggaggcgggcagattacttgaggccaggagtttgagaccagcctggccaacattgcaaaaccccatctctactaaacatacaaaaactagccagtcatggtggtgcccacctgtaatcccagctactggggtgcctgaggcatgagaatcgcttgaacccaggaggccaagaggcagaggttgcagtgagctgagatcacaccactgcacttcagcctgtgacagagcaagcaagtaggcaggcaggcagagagaaaggaagaaaagaaggagagacggagagagggagggtggaggggggagggaaggaggaaggagggaaggaaggaaggaaggaaggaataattactagaacaaagacattacataatgatgaaagggtcaattcaccaagaagacacagcaattctaaatatataggcaccaaacaacagagcttcaaaatatgtgaggcaaaactgataaaactaaatggagatatagataaatgaacaattgtagttgaagcttcaacatttctctctcaaaaattgatagaaaaagtagacagaaaatcaacaagaagacagaatctcaaacaccatcaactaacaggatttactccacatttacagagcactacctaacagcagtggatacacattcttttctagtgcccacagaaccaaccatatcttgggccgtaaagaaacctcaaaatcaatgaaaccaaaagttggttctttgaaaagttcaacaaaattgacaaatcttcagctagattgacctaaaaagagggaggaaacccaaattacctaaatccggaatgaaagaagagatatcacttgtgggcttacacaaataagagtgattttatttatttattctactttattttatttttttgagatggagtctcactctgtcacctaggctggaatacagtggtgtgatctcagctcactgcaacctccacctcctgggttcaggtgactctcctgcctcagcctcccgagtagctgggattacaggtgcccaccaacatgctgggctaatttttgtattttgtatttttagtagacacggggtttcaccatgttggccaggctgatctcgaactcctgacctcaggtgatccgctggccttggcctcccaaagggctgggattacagatgtgagccacaacacctgaccaaaatagtgattttagaggaatactatgaacagttgtatgccaacaaattagttaacctagatgaaattgaccaattcttagaaacatagactaccaaacctgactcaaaaagaaatagaaaatctgaatagatctataacaagcaaatataatacaaaaaattagccgggcatggtggcagatgcttgtaatcccagctactcgggaggttgaggcaggagaatcacttgaacccaggagatggaggttccagtgagtcaagatcgcaccattgcactccagtctgggcaacaagagcgaaactccatctcaaaaacaaacaagcaaacaaacaacaacaacaaaaaacacaagcaaatataacaaacaaacggattgagttaggaaaaagaaaaaaaaaaatccaacaaagaaaagtctaggaccagatggcttcactggtaaattctaccaattttttttttttttcgatggagtctcgctttgttgcccaggctggagtgcagtggcgcaatctcagctcactgcaacctccaccttccgggttcacgccattctcctgcctcagcctcccaagtagctgggattacaggtgtctgcaaccatgcccagctaatttttgtatctttagtacagacagggtttcgccatgttggccaggctggtctcgaactcctgacttcatgtgatccacccgcctcggcctcccaaagtggtgggattacaggcgtcagccatggcgcccggccctatcaaatgtttaaaaaacaactagcaccaatccatctcaaactctcttacgaaaaagaaaaaaaagagagagggaattcaatccattctatgaaaccaatattactttgacaccaaaagtaaagcaaaaaaaaagaagaagaagaaaggaaaaagagagaggaaactacagaccaatattccacatgaatatagatgcaaacattcttaacattttataaaataaattcagccgtatataaaaataattatacaccatgatcaagtgggatttattcctagaatacaagcttggttcaacttccaaagatcaatcaatgtataccaatgtaagctaaagaagaaaaatcacatgattatattaattgacacaaaagaagcatttgatgaaattcaacacccattcatgataaaagctgctggtaaccagtaatagaaacttcctcaacttgataaacagtgtctacaaaaaacctacagctaaaaattatacttaatagtggaaagctgaatacttttctgtgaaaattagggacaaggcaaaaattctgccttcactactcttactcagtatagtgctggaagttccagacatcacagaaaggggagaaaaggaaagagatagagatcagaaaggaaaaaccaaagctgcttctatttgcagatgacataaatcaattcccatggaatcttttaaaaagccttagaaccaacaaatgagtttagcaagatacaaggattcaagatcaacatacaaaaatcaattgctatttctatgttctagcaatgagcacatgaaaaccaaaataaaaaataatatcatttgcaatcactcaaaaaatgaactaggtgtaaatctaaccaaatatgggtttgtatggataaggacttgtatgctgaaaactacaaaaccctggtgaaagaaatcaaagaagatgtaaataaatagagaggtatggcctgttaatggactggaaaactcaacatggtgaagatgtgaatagttcgattcctttcaaaattctagaaagatttcttggccaggcacggtggcccatgcctgtaatcccagcactttgggaggccgaggagggcggatcatgaggtcaggagtttgagaccagcctgaccaacatggtgaaaccccgactctactaaaaatacaaaaatcagctgggcgtggttgtgtgtgcctgtagtcccagctactggggaggctgaggcaggagaatcacttgaacctgggaggcagaggttgcagtgagccaagatcacgccactgcactccagcctggacaacaaagcgagactccgtctcaaaaaaaaaaaaaaaagaaaaagaaagatttcttatagatataggcaagattattctaaaatttataagaaaaagcaaaagaattaaaatagttaaaacaattccaaaaaagaagaataaagtgggaagagtcactctaccaaatttcaagatttgtatagactgtttggcattggtgaagggatagatacattttgttcaatgaaacagcctagagaacccagaaacagccccatgcaagtatagctggctgatttttgacaagcatgtacaagcaattcaatgatacaaaggaatcgaaaccaggaactcaaacagacatttgtacctcagtgttcatagcagcatcattcacaacaccccaaaggtggaaaaacccaaatatccatcagtgaatagcaagataaacaaataaccaaacctaaaagtggcatatccatacaatggaactttattcagccttaaaaagaaagaagattccagtacatgccacaacatagatgaaccttaaagacatgataccaggtgaaataaaccaaacgcaaaaggacaaataccgtatgattccactgacatgagggagaggcctggagtagtcaaattcatggagacagaaagtggaatggggattgccggggtgggggcgtgggacagagtgcaaaatagggcttttctgtatctattgaaattttgttgctgttgttgttttattctgttaatgtcgtgattcacactatgtaattttatatcaaccctgtatttttgcgataaacccaacttagtcatgatgatttatgttgtttttttcttttttgagacggagtctcactctgtcgcccaggctggagccatctcggttcactgcaaccttcacctctcgggttgaagagattctcctgcctcagcctccgagtatctgggattacaggcgcgtgccaccactctgcctggctaatttctgtatttttaatagagacggggttttaccatgtcggccagactggtcttgaactgctgacctcaggtgatccacctgcctcggcctcccaaagtgctgggattacaggcgtgagccaccgcgcccagccaatttctgtatttttaatagagacggggttttaccatgttggccaggctggtcttgaactcctgacctcaggtgatctgcctgcctcggcctcccaaagtgttgggattacaggcgcgagccaccgcgcctggtcgatttatcttttttatacattattggattcagtttgcatctctgttcatgagtgaaatttaccagtaattttatttttttgtcctgttcttgttcagtttgtatgtcaagattacgttagttttataaaactgaagtgaaagtgtttctcacttttctattctctgaaataatttgtacaaggttggaattatctgttttttgaaaggcagaatttgcttgcaaagttattttaacatttttgggggaggaggggaatattttaaattactgattacatttctgtaattgttgttaagacaattgaggtttatttcttttttattccattaaaagaaacctgtgtttttccaagaaattatccagttcatctgttttcaaacttgttggcataaagttgatataagagcctcttatattttcatatacttgctgacacacccatgttaaatctgttttgtcctggtgttttttatttgtgcatcctctcttcttcttgttaatacttccagaagcttggctttatatttgtatttccaacaaatcaatgtttgactttgctgccttaaattttatttaatctgatattgaccaaattaacaatttttctcttggttagtctttgcacagtatatctttctttcccttgacattcaatttttctttttctttctttttcttttcttttctttttctttttctttttttttttttgagtcagggtctctgtcacggaggctggagtgcagtggtgcaatcatagctcactgcagcctccaactcctgggcttaagtgatcctcccaactcagcctcccaagtagccgagaccacaggtgaaacaccaccacaccaaacttctttttcttttgcagagacagggtctcaccatgttgcccaggctggtcttgaactcctgcctcaagcaatcttctgccttggtctcccaaagtgctgggattacaggcgtgagccatcacacccagcccatttgggtttatttgtgacattttctgcccagctttcccactcattcctcctttcttgcatcttttgggtgtgagagagagaatgtgtctttttttttttttttttttttttttttagagacggagtctcgctgtgtcaccaggctggagtgcagtggcaaaatttcggctcactgcaacctctgcctcccgggttcaagcaattctcctgcctcagcctcctgagtagctgggactacaggcacacgccaccatgcccggttaatttttgtatttttagtagagacagggtttcaccatgttggccaagctggtcttgaactcctgacctcaagtgatccactcgcctcagcctcccaaagtgttggggttacaggcgtgagccaccgcacccagccacgtgtgtgtcttttattccctgctttcccttctgcctgtttggcacttataactactgtgcctatttcatggatgccctccaaagttaatatctgaggttaatgtttttccctcctcccattccaatgggtattctcccaataccagagccttagcatgtatcacctgctaccagctcacatgccattgttgcccagcgcacgtgctgggtgtactggtgtgcagagtccaacgggagggctgggagaaggcccccgacctccctgccctctcagactgtggccgcacccagcttgccagacggagagcccaggagcaggaagctggtgtaaacacagggcgggcacccacactgttcccaggagccagtccttagatcctatctggctctcaccctgcctttgtcaagccctcaggacttggcacccaggtctgatctgggtgggcgtttgtccaaacaagaagtgagccagagctggacatccaggaccagaccataccacacagagggcatggggacactctcccagggcctgcagcccttcccggggctgctcttggcagcccaggcaccctggaggatatgcagtgcctctctgcccacccacacccctctggggctggcagggcctggagtgtgcgtgggcatgcagacgcatacacatctagcccttggctctcctcattggaccccttcagacactcctttctcttcacacttttacggaaaaggcacaagtggggatgtcctgccctgtgactggccttggctggcctggcccctgtagcacacgctggtggaaggaatgtccacagtgcagaaggcgctgctgcagaccgtgggctcacccgttctcattccacctgcaggtggaccaagcctggggtggcggggacaggccccacagactgaagtgacaggggatggagaagggctggggacagaggggacacagccacctacctggcaagctaagaggtcgggaagagtagctgccacttacatgggtttagacaaacaaacaggagttcaccagggtgaagggaaacgggagacctggctaaaagcaggaaaaagtaccagcatgggagcgggggcaacagcagaaccccagggagggtcagatggggtgcagcgccgggaggccagccagttccctggaagagagtttgcaggactaaagcctagagcctagattgctgcaaagtttcccagaagcggctgttgaacaatagtcacggccgggcacggtggctcacacctgtaatcccagcactttgggaggccaaggcgggcggatcacgaggtcaggagattgagaccatcctggctaacatggtgaaaccctgtctctactaaaaatacaacaaaaattagctgggcatggtggcaggcgcctgcagtcccagctacttgggaggctgaggcaggagaatggcatgaacctgggaggtggagcttttagtgagccgagattgcgccactgcactccagcctgggcgacagagcaaaactctgtctcaaaaaaaaaaaaaaaaaaaaaaaaacaacaatagtcacacggccacatctagctgggaggaaaggtgaaatatgttttagctgggtggccacgactagtgaaacatgaggcctgtatttttgctggggcagtgagcatccttggccacatgctgggctccagggggacggccaggggcattggccagggaaggagcccaggagagcaaacagaacctgcatactcactcccctccctcccagtcccatttaatctaactgtgaagacagtgaaaactaataagcccacagtaagaggggaaatactcgagactgccatcagttgaccagaaattttggaagagtttgaagaatttttgggagacaggaagcagataggatcagggcatagttaagggcacccaggcagaagccacggccctgaaggagcccccggcaagggcagggatggctgcagttgccagctttagccctgagagcagctttgtgaggcaggcagagcagttcccgggagggcccaccacagtggtcagagaggcagcaaactggctccgccgtgcagctttgggcggaaaggcaggtcctgccaggaaagaaaccaagcagagtcagttaaaggaggtctcctggtggtcctagagtgttgtgggggaggttacgaacaggtcttccacacacctggtgggagtgtgaggtgacacaaccacttggagaacagttccccagtatctcacaaagcagaacgggtgcgtagcccatgagccagaaaacaaggacccgtgtgtgccagagtagtgatacgagaatatccatgggagcattgcccttaatcccttaatagtgctaactagagtgcacacaagtgtccatcaacaataggctggatgaatgcactgtggtatattcacacagtggaatacatgcaatgcagagcaacacacagcttgtatgaattttataaaggtaacagcgggtgagaggcacaagcccctgaactgtctactgtatgattctgtggcagattgtattttccaaagatgccaccaaatgtagagacattcaaagatatcacccattggacattctctttttcattttacttttgtaaaaattgcgggcggtggtgatggttgtacaacaatgtgaatatactattgctactgaactgcatactgaaaatggctaagatgaggccgggcgcgttggctcatgcctgtaatcccagcactttgggaggccaaggcaggtggatcacttgaggtcagaagtttgagactagcctggacaatttagcaagaccctatctctaccaaaaaacaacaacaaaaaacacatttttttttcattagccaggtgtggtggcacatgtctgtagtcccaggtgttcaggaggttgaggcaggaggatcacttgagccacgaggtcaaggctgcagcgagctgtgattgtgtcattgcactcctgagtgagatcctgtgtctaaaaaaagaatgtggtaaaatatacatgacatgcactttacttttttttttaaccgagttttgctctgtctcccaggctgcagtgcagtggcgcaatcttggttcactacagcctccacctcccgggtttaagcaattctcctgcctcagcctccctagtaactggcattacaggtgcacaccactacacccagctaattttgtatttttagtagagacgggattttgccatgctgaccaggctggtctcgaactcctgacctcaaatgatccacctgcctcagcctcccaaagtgctgggattacaggcatgagccactgcgcccggcctcatcttaaccattttcagtatgcagttcagtagcaataggtacattcacattgttgtgcagccatcaccaccgcccatctccagaactcttttcatcttgtaaaactgatactccatacccgccaaacactacctccccagtaccctcctgttccagtccctggcaaccatatctactctctgtctctatgaatttgactactctaggtacttcatgtaagtggaatcatacatgaggtatttgcccttttgtgactgacttgtttcactaagcataatggcctcaaagttcaaagttcatatattttgtagcatgtatcagtacttcatgaatttttttttgttttgagacagagtctcactctgttgcccaggctggagtgcagtggtacagtctcagctcactgcaacccccacctcccaggttcaagcaattcttctgcctccgcctcccgagtagctgggactacaggtgtgcgccaccataccgggcttttttttttttttttttcgtagagatggggtttctccatgttggccaggtctcaaactcccaacctcgagtgatccacccaccttgacctcccaaagtgctgggatgatacaggcatgagacaccacactcagccttgttgttgttgttgttgttgagacaggatctggctctgtcacccaggctggagtgcagtggcctgatcatggctcactgcagccttaacctcccaggttcaatcaatcctcccacctcagcctcccgagtagttgggactacgggtgcacgccaccatgccttggtaatttttttgtattttttgtagagaaagttttgccatgttgcctgggctggtctcaaactactgggctcaagcatccacctgcctctgcttccctgaatgctgggattacaggcgtgagacaccatgcctggcccttcattccattttttttttttttttttgagacagagttttgctcttacacccaggctgaagtgaagtggcgcgatctctgctcactgcaacctccgccccccaggttcaagtgattctcctgcctcagcctcctgagtagctgggattacaggcgcctgccaccacgccctgctaatttttgtatttttagtagagatggggtttcgccatgttggccaggctggtcttgaacttctgacctcaggtgatccacccgcctcaacctctcaaagtacaggcatgagccaccgcgcctggccccttcattcctttttaaggctgagtaaaattcccctatatagttatattacatttgtttatccattcatcaaccaaaagtccacttggggccagggatggtagcttgcgcctgtaatctcaacactttgagaggccaaggtgggaggaccacttgagcccaggaattcaagaccagcctgggcaacatagcaagaccccttctctacaaaaaaaattggccaggcatgatgatgcatgcctgtagtcccagccacttgggaggctgaagtgggaggatcgcttgagcctgggaagttgaggctgcagttagcagtgatcgcaccactgcacgtgagtctgggtgacagtgagactgcctcaaaaaatgtttttaaaaatacagtcgtattggctgttccaaatgatggtgccatgaacatgggtgtacaagcatgtgctgctcttatgatacaatgctgatgtgctccccatcaaaagctggggtctatattccctctccttgcacctgggaaggttgtgacagaaatgatgctatgtgacttccaggctagatcataagaggtgatacaacttgctcctcatcctctttagtggctcactcttggagcccagtcgccatgttgtgagcaactcagaccagacttagaggccacatgtagatgttccagctggcagccagcatcaactaccagatagagggaaagagttttccaagcaaccccagcctctgtgactatctgagcaagaaccacccaggcgagcccagtcaaccccagagccatgagagatgacagaaatgactgttgctgtttcaggccactgaggtttggggtgtttggagtgcagccactacatgcaccctacaaagaagtctgccctgggatgggaccccccacatcccacagccacctccaaacacaggaccagagaccccaggatcagcaggccaaaatgaccataaaggaagcccaagcttgccaccctgtcaacgaggaagtcccagatgggagatagtaatgcgagaacaaaggaaaacgtaagcaaccttgatgatgtgaaataatagtaaagctgatggaaacggggaggtagagcaggaagatttcttcatcttgcacagtggggtccgtcataaaatatctacagcaatagaggtctggggcaggtccaggctccactaggtggctgtaaggtggcttgttggacggacccgagtcactggtgtcactagtccctgaaatcacagcatctccactgctctgacaatgacaggtttagaggttaggccccagcctgctgggtatgcatttcctttagtgctggagatggactcagaatgcgtatgtgaccctatgtgggccagcaattggccagtgcaagattgctggggattctgggaccggggtccttattttcaagatacagccatgtgaaaaaatggctcctaccaacacacgaagagggaaactccgcactcctattgcttggcagccatccttccatcactaagggaaccagccttaggataaagctgaggggtggagcaatggaaggtactcaggtttctatcacagtttttgtttgtttgttttttgagacagagttttgctcttgtagcccaggctggagtgcaatggtacgatctcagctcactgcaacctctgcatcttgggttcgagcgattctcctgcctcagtctcccaagtagctgggattacaagcgcccaccaccacgcccagctaatttttttgtatttttagtagagatggggtttcaccatgttggccaggctggtctcaaactcctgacctcaggtgatctgcccgcctcaggctcccaaagttctgtgattacaggtgtgagctactgcgcctggccccagctaatttttatatttttagtagagatggggtttcaccatgttggccaggctggtcttgaactcctgacctcaggtgatctgcctacctcagccttccaaagtgctggaattacaggcatgagccactgcgtccagcctctatgatggttctgtaaagcctgtaagctgaacagccctggagcctgccttacctctgaacatccactggcatgagccaataaattgctatattaagaccgttctagttggatttttttccttttttttttttttagacagggtgtcactctgtcacccaggctgcagtgcagtggtgtaatcatagctcactgcagtctcaaactcctgggctcaagcgatcctcctccttcagcctcctgagtagtttggactacaagaacgtgccaccacacctggtgaatttttaaatttttcttttgtagagacgaggtcgtgctatggtcaccccggctagtttagaactcctggtctcaagtgatcctcccacatcggcctcccaaagtgctgggattataggcatgagccaccatgcccagctgtttctttcctttttaaaacattttttattgagatacaattcacataacataaaattaatcactttaaagtttatacttcagtggctttagtatattcactatgctgtacatgcatcgccacggtgtaattccagaacatttccatttccccaagagaaaccacaaatctgttggcagttattctccacttctccccaccccatgccctaggtatccaccaatctactttctgtcttcgtggatttgcctgttctggacatttcatagaactggaatcacacagcatgtgggcttttgtgtctggcatctttctctccgtagattttcctattctggacatttcatagaaccggaatcacacagcatgtgggcttttgtgtctggcgtctttctctccatggatttgcctgttctggacatttcatagaaccggaatcacacagcatgtgggcttttgtgtctggcatctttctctccgtagatttgcctattctggacatttcataaaactggaatcacacagtatgtgggcttttgtgtcgggcgtctttctcttagcacagtgtttccaggttcatccgcgctgtagcctcattcaacacctcattatctgtgacgctaaataatattcctttattctgtttatccatttacctgttggtggtcatttgtgttgtttccatttttgggctattgtgaatagtgctgttatgaactttttttttttttttttttgagacagagtctcgctctgttgcccaggctggagtgcaacggcatgatcttggctcactgcaacctctgcctcccgggttcacgccattcttctgcatcagcctcctgagtagctgagattataggcgcccaccaccatgtccagctaatttttttgtctttttagttgagatggggtttcaccatgttggccaagctggtctcaaactcctgacctcaagtgatctgcccaccttggcctcccaaaatgctgggattacaggcgtgagccaccgcacctggtcgattactatagttttgtagtaagttttgaaatggagaagtgagtcttctaacattgttcttgtccaagactgctttggttctttctgtgtcccttgcagttccatatgaattttagaatcagcttgtccatttctggaaaaaaaaaaaaagctgttgaaactttgataggtattgcattaaatctgaagatcttaatgttaagttttctagtccacgaatatagaatatctttccattttctttcaacaatgtcttgtagattttttatagcagccttgcactttttaaattaaatttatttctaagtatttcaagactattcttttgatgctgtattttcttaatttgattttcaaattgttcattgccagtagatagaaatgcaactggttttgtatattaatcttgtatcctgcaactttactaaactcacttattagctctaccagtttttgtgcagattctttagggttttgtttggttttgttttgacagggtctcactctgccacccaggctggagtgcagtggcatgatcatggctcactgtggccttaatcttccaggctcaggtgatcctcccacctcagtctcctgagtagctagaactacaggtgtgtgccaccatgcccagctaattttttgtagagatggggttttgccaggttgcctgggctggtcttgaactcctgggctcaagcaatccacccacctcaacctcccaaagtgctggtattaaaggcataagccaccatgcccagtttctttagggtattctttatacaagatcatgtcatctgcaaatggagttttacttctttctctccaatctagatggctttttgttattttttcttgtctagttgcccagcctagaatttctagtacaatgttaagtaagtggcaagagtggccatctttgtcttgttcctaatctcaggggtaaggctttcagttttttaccattaagtatgatattagctgtgggcttttcacagattccctttatcagactgtgcgagttccctcctattcctagtttagtgcatgatttttatcactaaagggtatcctgactttgttaaattttttttttttttttttttttttgagatggagtttcactcttgttgcccaggctggagtgtgtgatctcggctcactgcaacctctgcctccccatttcaagtgattctcctgcctcagcctcttgagtagctgggattacaggcacccgccaccacgccccactaattttttgtatttttagtagagatggggtttcaccatgttggtcacgctggtctcaaacttgtgacctcgggtgatccacccgccttggcctctcaaagtgctgggattacaggcatgaacgaaccaccacaccctgcctgttaaaggtttttgtcaaattcttttgtgcctatttagatgaccttgtggttctgtccctttattctattaatatgatgtattacattgattaggttctgtgttttaaaccaaccttgcattcctgggatagatcctacttggtcatggtgtacaatcctttaacatgttgctgaatttggtttgttagttgtttgttaaggatttttgaatccaaatttataagggatattggtctgtattttttattgtgatgtctttgtcgggcttcacagcataagtcagtaagtgttccctcctcttctgttttttggacacatctgagaagtactggtgttaacccctctttaaacatttggtggaatttgccagtaaagccgtctgatcctaggcttttcttgctagaactttctttctttttttttttaactagtaactccaaattcatcaaatttgggaagatttcagcctttatttcttactaagaatgaggcatttctcttgaatgttttcctcatgttgctacaaacctttttttgtttgcttgcccttttttttttttttttttttttgagatagagtcttgccctgttgcccaggctggagtgcagaggcatgatctcagctcattgcaacctctgcctcctggttcaagcgattctcctacctcagcttcccaagtagctggggttacaggcatgcaccaccatgcctgttttctgtttgtttgttttctttgttttgttttgttttttgtatttttagtagatactggatttcactataaggctggtctcgaactcctgatctcaagtaatccacccgactcggcctcccaaagtgctgggataacaggcatgagccaccatgcctggcctgctgcaagccttttaatgtccagagctatttttaaaaagttgatttttgagttttttcccttttttcattgttttttgtggaggggtgaaatttgtatttcttcatcctccatcttcactgatgtccttccttagctgggtttctgatagggcagacaaaaatgccccaactcctaagacacttatttagttataaggatgatggttttcaaactttagtgaacacaattaactaggggagactattataaatacacattcctaggtcccaccacaaattccaatgagtttgtctgcggcctgggaacctgcattttgaaagcactggattacaagatctaaaagtaatgaacaaattgagaggttgagaggaggagaggttgtctaaatatgttaacttcacattgatttcatacaatagagccaaaagaaactacacagttgagaaatcaagatgtgggttgtatgctttagaattacgaaggcaaccactgtaagaattagaaacaaaaatagttaagacaggccaccttcagggaatggagttggagtaagacagggcaattttaaattttctttatagtttgagctttctttctcaaatacagctgttatctttataataaaacaaacacaaaaatgacaagaaaatcagtaaaaggggactattggccaacaattctgtcttcccttcccagtgcctctgccagtgtactcatccatccaccagcagctatggcccaggggcgtgcagcctggctcctcagaatggcacatggagctgggctcctcccaggagccacattccttcccacctccccccagaggcaggcatgggcaactgaatgcaaacaagatgaagaggaaggacactgtaaactaaacaattgttagcttccagacgcagccacaacctggagtcacagagccctcctggactcagggccaaaagagacctacacaaggtcacatagtgacccagtccttcccagaaccagtagtctttggagcttaaaaacataagcataggccgggcaggatgactcatgcctgtaatcccagcactttgggaggccaaggcaggcagattgcttgagctcaagagttcgagaccagcctggggaacacggtgacaccccgtctctactgaagtacaaaagaaattagccagcgtggcggcgtgtgcctgtagtcccagctactggggaggctgaggcaggagaattgcttgagccagggaggcggaggttgcagtgagccgagatcgtgccactgcactccagcctgggtgacagagtgagactctgtctttaaaaaataaaataaaataaataagcataaatctaaaacactttgcttggaagctggcctcaggcttagcttataccatgaattcatctgccaactgtttcagaggtctgggcagaagggctgcccagcaggaaccagaggtctggaacaaccaagtggggatggctgattctgagggagggatgggcatgtgacagtgtgccctctgaactgtgggggaatgtggctcccccgacccctgggctctggggggctgttttctgggtgaaggtgatccagactgttcaggccaaagccccagtgccagagactcattgtccctcccacggtggagatgttcctctctcaaggtgtcctgcattagcatgggacgttctcctccactccaccgtgcctggaatccatgtgggcaaggatgaggagggaagcagctgttagtgggaagtgaggctgtgggactccagcgttctggacagtcccagcccgaggtgacactactctgatgtgctgagtggctgacttggtagggagttagtgtttggaggttttctcacaattccatgagaatccagggcaggccatgatagtggggaaggctttcacatgacgcagcactggagctggacctgctggctgggcaagcttcagacacaggagggtggtggcatatcctttgctgtaacaggcagaaaatataatgatgtgacatgccccacctgggcccatcttgcctctggccctgcaggccttctgaaaccagctctaggaggcccagggaaccccacaggcaacaccagatttgaccccaccaaggaggccatgacaggtcccagtccacaagatgaacactatgctctttaaaaagaactcctgtcttagttggtgttagttcccagccagtgaagtcacaatgatggtagcaacaggtaccatcacctggcacctgctgagtgccaggcatggttcccagggatgcacacacacaacgctaccccgcagccccagccatccatgtacccctgtggaaaggaaggcacagagacacatcacgggacttgagagtggcagagtcaggatctaggcgggcagtcagctccagtgggggttcacagcccctcgctactctgccgttaccttcatccatgacaatgtgaccagtcatctctgcagctgcaggggccagtaaagtgcgagactcctaattccagtgcatatttgctgaatgagagaatgaaaatgtgtacccacatacctcaggtacctacaacagactgtcattataactgcaagagacagagtgaaattaatagacaccgacatgtcctcagcaattccaacaaaacaaatagtgacaagtacccaagttagtatgacctactagtctccaaatcatagtaactggtggtcaaaatgaagaggcaggacattccacaacagtgtggacgcaccaaaggaatgggcaaaaacacacacctccttcttctcaaaagtatgtgtactggttttctatggctgacatacaaattatcataaatttagcaacttaatacatcctagcactttgggaggccaaggtgggaggatcacttgagcccagcaattcgaggctgcagtgagctatggtcaagccactacactctagtctgggcgacagagtgagatgttgtctctaacaacaacaacaaagcccagttcgggtggtaaaggtggcatttcatagcgatgggatggtgcagggtgatcctggcagggcaggtgatgagagtgtggaggcagagcctgggaaacctccatgtcaatatgatcacagaaacaaggagcgctccatcgcaactggggcaaagtagaaaacgcactgagggactgacctgatgaaggtggagggtgcgaaatgcaatccaaagtaaagaagagatgagggtgcagaaaattatgggcaagaaacaatgctctcaggttctagatttgtggtcttaattgaatcacaatttggagaggcttattttgtttttatttttttgagatagtctcgctctgtcgccttggctagagtgcaatggtgccatctaagctcactgctacctctgcctccctggttcaagcaattctcctgcctcagccccctgagtagctgggattacaggcatgcatcaccacgcccagctaatttttgtatttttaatagagatggggttttactatgttggccaggctggtcttgaactcctgacctcagatgatccacccgccttggcctcccaaagtgctaggattacaggcatgaaccactgtgcctggccggagagtcttaatttataaactttaaaacttcagaacactaaaaaaaaaaattaattaaaaaaaaaaatatatatatccatttgggccacatgtggtggctcatgcctgtaattccagcactttgggaggccaaggcaggagggttgcttgagcccaggagttcgagaccagcgggggcaacatagcaagaccccatctccaccaaaaaaaaatacaaaaattagctgggcgtggtggtgtgcacctgtggtcccagctactctgggggctgaggtgggaagatcatttgagcctgggaggcagatgttgcagtgagctgtgatcgctcaacctgtcccccccacaacaaaaattttgagaatctgtctcaaaaaaaaaaaaaatttgttttgttgaaccatggtctagagaattattaatagtaaagaaaatagaagtaaaaacttatttttaataattgctcatttttgttttctaaatataactcttttatttattttatactattcatttatttatttttgagacagggtctcactctgtcacccaggctggaatgcagtggtgggatcacagctcattgcacccttgacctcctgggctcaatcgatccttctgcctcagcctcctgagtggctgggactacaggcatatgccatcacacccggctaatttttttgttttgttttttgagacagagttttgctctttttgcccaggctggagtgccatggcatgatttcggctcactgcaacctccgcctcccgggttcaagccattctactgcctcagcctccagagtagctgggattacaggcatgtgccaccacacccagctaattttgtatttttagtagagatggggtttctccatgttggtcaggctagtcttgaactcccaacctcaggtgatccgcccgcctcggcctcccaaagtgctgggattacaggcgtgagccaccacgcctggccaacacccagctaattaaaaaagaaaatttgggggatgggcacggtggctcacgcctgtaatcccagcactttgggaggccgaggcgggtggattacttgaggtcaggagttcaggaccagcctgaccaatatggtgaaaccccgcttctactaaaaatacaaaaattcgctaggcatgggggcacgcacctgtagtcctagctacttgggaggctgagacaggagaactgcttgaactggggaggtggaggttgcagtgagctgagatcgtgccactgcactccagcctgggcaacagggcgagcgagactgtctcaaaaaaaaaaaaaattttttttttgtacagatggagtctcacgaggttgcccaggctggtctcaaactcctggccacaagcaatacctcccaccttggtctcccaaagtgctgggattacaggcgtgagccaccttgcccagccaaataaactcttctaaagattgttcccaggacaagtttagggcaaatgttccacaaactactacatgtaagcacatgtgtgattacgactgaactttcacctgatttgtgaggccccaaagtagcctcagaaggaaagagccaggcccctcaaactgcggggaggtgagtattccacgctcacctgggccagctcctcctcctgcagctcaagggctcagcctggtggggtgctgttccccagggcgctaaggaggagccagtttctgtctcacatgggttgatggccatgcagcttgatttcctctctgagtcaaaggaatcttgtcagggccaggcccgcagctgccctcctgtcttggaaaactaagaactgcaccccacccctgcaagtctgtccatagccccggcaatgccacgtgctgccttccttttctgcatactggtcttggccacctgccatcaccatgtggccccagtcaccttccatcaccatgtggcttctcctatgccctggtccttgcccctgaggcatttaagcacatctccacacccgctcaacactgcagtgcagccattgctgtgtgcttctgatctcggtgagttcgcatgctcaagaagtctttggcacagagtttacgacctcaggctctccagttcaatgggcctaggttcatcccagacctgttctatttactagctaagtgcagttgtcttaacctcagtgagctcatctagttatatacagaatggtgatggcaatacctaccttataacattggactgatccacccaacaagcataccttgggcaccttccagtgttctctgtgtgggggtacagctgaactgccacagggtgacaaaggaactagagctggggttgggggtgggggctgctggggctggcccaggcaggaccttcagtgcctggctaggagccttggactctgtcctcagagcagtgggaacccaccggagggcttccgttgcagggtgggaagggtgatggggtatgccagactcatccaaacaaagccacagtctttggggagggggcagcaactggaggcagggggactgcacaggcagctatttgcaaggattctgcaggcaaaagtagtgtggggggaaattggggatgaacttgaaacttaggtgatgggtggggatgtaaattcattcaacctttatggaaaacactaggaagatttctcaaagaactgaaaatagaactaccattcgatctggcaatcccgttgctgggtatctaaaggaaaagaaatcattacgtcaaaaagacacctgtatttgtatgtttactgcagcactattcacaatagcaaagacaaagaatcagcttgagtgtccatggatggaagaatgaagaaagaaaacatggtatatatacacaatggaatactatttggacataaaaaagaataaaatcatatcttttgcagcagcatggatgaaactggaggccattatcttaagtgaaacaagctggacacagaaagacaaataccacaggttctcacttgtaagtgggagctaaataacatgtacataaggacttagagtgtgaaatgatagacaatggagactttgaagggtgaggggtgggagagaggtggctggtgagaagttacttaatgggtacagatatttgggtgttggataccctaaaagtccacacttcaccaatatacaatctatggatgtaacaaaactgcacctataccccataaattcatacaaataaaaaagaaatttaggtgataagagctatgggccttggttaccagttctgtgcatgtgcatgagtgtgtgacttgtggcatcacacggtgtcagggagccgatcggggcactgggagaggtgataaactagaatttggaaatgctgaattcgaggtgcctgtgaggtagcaagtgaggaagtccagtaggcagtgggctagacatctggaatttaggagagatcttaatggaagaaaaagatttgggaattagggttttcggggggtaattggcagagaattgagggaggagatggtgtggggtatcttcttttttttttaaatagagtcttgctctgttgcccaggctggagtgcagtggcacaatcttggctcactgtaacctctgcctcccaggttcaagcaattctctgcctcagcctcctgagtagctgagattacaggctactcgggattacaggcctggctaattttttgtatttttagtagagatggagtttcgccatcttggccaggctggtcttgaactcctgacctcataatctacccgcctcagcctcccaaagtgctgggattacaggcatgagccactgcacccggcccatatcttaattttttttttttttttttttgagacggagtctcactctgtcacccaggctggagtgcagtggcgcgatcttggctcactgcaagctctgcctcctggtttcatgccattctcctgcctcagcctcccgagtagctgggactacaggcacccaccaccatgcctgcctaattttgtgtatttttagtagagactgggtttcaccatgttagccaggatggtcttgatctcctgaccttgtgattcacccgtcttggcctcccaaagtgttgggattacaggcatgagccactgcgcccagccccatttccattcttgtttccaaaggactgtatcggctgtactatcacccctgtagggacactccctcaaacaccaaggactccttggtataacagctgcactttcagtatctgctgatcaagaaaatatataatgacaaaagtgcattataaggtcagcaatgtaggtattattttataatttttttttttttttaaagacagggtcttgtcatgtccaagctgatctcaaactcctgggctcaagtgatctgcctgcgttggcctcccaaagtgctgggattacaggcatgagccactatgccaggccaagctcagcaatatcttaagtgagtccgtattttattttttaatttttttaaatttattttatttatttaatttttgagatggagtctcgctctgtctcccaggctggagtgcagtggcgcgatctcggctcactgcaagctccacctcctgggttcacaccattctcctgcctcagcctccggagtagctgggactacaggagcccgccaccacgcccggctaattttttgtatttttagtagagacgaggtttcactgtgttagccaggatggtctcgatttcctgaccttgtgatccgcctgcctcggcctcccaaagtgctgggattataggcgtgagccaccgcacccagctgagtctgtattttattaactgcaatggcatctatatatatttggaaaatacagtactgtgtccacatgctctgtggaagctctgttatactaatttaatgataaatgcaaattactgagctatctcatctcaggaggtataaattactttctctaattgctaccttcaatgaatctctgtcaaatttcccatatttcccttaacaatactttgggcagatcccgtaagttcccaagcagttattcaaagtccagctagttcaatctcaaatacagggtaagcctttgcccactcccatcaccatgtgggtttatggcttaggactctttaagagaacaggtgggatgtgctgcctctgaattcccaccactctccttagggtctcccttctctgatgtcaggtcatggagaatgaattagggaaaacggcaaaagtctttccacgtacagggtacactggccgtatttttctcaggctaacactaatttaatttttttttaaattgaggtatactttacttacaacaaagttcaccaattttaagcacacaattcaatttttgacaaataactaccacaattatgatacaaaatattttcactgccgagcccactttgtgctccatgcagtcaatcctttcccccaacacctagcccctaagtactcatctgctttctctcaccacagtgttgcctttctagaatttcacagtatgcagcccttggtgtctggcttctcctgctgagcctgacaaatgtgagactccttcttgctgtgtgcagcagcagtctgttcctttattctgccaagtgttattccactgtatggatctacctgttccactttttgtttgtttgtttgagacggagtctcgctctgtcacccaggctggagtacagtggtgcaatcttggctcactgcaacctctgtctcctcggttcaagcgattctcttgcctcagcctcctgagtatcttggattacaggcatgcaccaccatgcccggctaatttttgtatttttagtagagacgggtttcaccatgttggtcaggctggtctcgaactcctgacctcaggtgatctgcccgccttggcctcccaaagtgctgggattacaggcatgagccactgtgcccggcctccactttttgactattattcataatgcttctatgaacattttgctataggtaagtcttgtggtgacatgtttctatgtctctgggctaagtacctagcagtaggattgctgagctgaatggttaagcggttacaacttcatgagaaattaccaaaatgttttccaaattggcctaatcattttgcattcattcctacctgctatatgtgagaattctagttgctccacatcttcatcaacacttgctactgttagtctttttaatttgggtcattcaagtggacatgtactggtttagtgatgtctcactggtggttttgtgtttctctaacaacagatgatggccaagcatccttcaggtacttatgtgtcatctgtattgtatttcttctttggtgaaatattattttgtttgtaaatcaatcaatcaatctacctatctgtctatctatctatctatctactgagacagggtctcactttgtcactcagctggagtgcagtggtgcaatcacagctcactgcaacctttacctcctggactcaggcgactctcccacttcagcctcctgagcagctgggactacaggcatgcaccaccacacctggctaacttgtttttttttttgtagagatggggttttgccatgttacccaagctggtctcaaactcctgggctcaagcgatctgcccacctcggcctcccaaaatgctaagatactgcattcagcctgtttgcaattttcttatagagccaaatgagttctttatgtattctgagtagaaatactttatgagatatgtgtttagatattctcctagtctgtagcttgtctttcattgtctaaatgaggtcttattaaaaattaattttctctgggtttattgaagtataatttacatttaataacactcaccctttttaggcagagttctgcgaattctaccactacaatcaagatatagaattttcccatcaccctcccaaaatttccctataccctcttctagtcaatcccctcccctcaaatgcaacccctggcaaccaaccactggtctaatagtgtcttttgaagtggtcaaagtttaaaatttgatgcagtatgattaatcaatttttaaaattatgtgtcttagtctgtttgtgctgctataacaaaatacctgaaactggataatttgtaaacagcaaattcatcacttacagttatagaggctgggaagtccaagatcaaggcacctgcaggtttggtgtccagtgatggctcgctctctgcttccaagatggtgccttgttgtgtcctcttgaggaaatgaacactgtgtactcacggtgaaagagatggaaaggcataaaagggctagctggttcctttgggcccttttataagggcactaatctattcatgaagttggagtcctcatgatctaatccctccctaaagtgttaaaatcaggtaacttaagttctccaactagctgtttttgatctctgtgaggccagtctgtacactaaccttttttttttttttttttttttttgagacggagtctcgctctgtcacccaggctggagtgcagtggtgtgatctcggctcactgcaacctctgcctcctgggttcaagcaattctcctgcctcagcctcctgagtagatgggattacaggcaagtgccaccacgcctggctaatttttgtatttttagtagagacggggttctaccatgttggtcaggctggtctcgaactcctgacctcgtaatctgcccgccttggcctcctgaagtgttgggattacaggcatgagccaccgcgcccagccccactgaccttctttcatggggagttcatgtaagtttttccaaaggctctgcagggtatcttcagtatagagtgttctgatatgggaaacgagctctagctcaacctccttcactcccaactccaactagctttgccatcagtgttactccctattgctgtttgctccacagcctcttgcctagtggatgtggtctggcattggacagcacaagcaatgacagggaagccccctgaagacccttgcccagaggtctctgagttttctagatttcttcaaagccaggtataaaggcagtctagcaagctcacactgtccaagcagacatccaatcagggaagatgccagcctctcttttttaggcatctgaagtcattatggtaactctctttgagctacaccctgttggctttagtaatagcaccgcaccctccctatttctgcacccaggaagctgcttagggaaactcttacccttcctcccgccccatccctcccccgttgtccagttatgtaagcctgagggtagggtggtggtggttcagaatggcagggctggctcttcagccctctaacaataagctctgggtgctgccatgttgtgctgcctttacagtgtgggatactgaatgcctctgggtactcacctttgtgccctgactcactaattccagggtaacaggaaaaggctcattaaacgtcccgttacacacagctctaataaaaacagcaataataacatcaaaacactcacatagtgcttgccaggcaccagtctctttctctacttatgttaactcatttcctcttcacaacaacccaccccattaagcaggatcagtaacccctttgcacagctgaggaaactgagacatagaggaggtaaactgcccaaggtcacagggacagagagccagagagctgcaatccaatcgagggagtttggctggagtccacgctgcgctgctttccacataggagaggcagagaaaagctgcacctgcaagagcgatggtttcggctgcgtatttggaataacgaagtcagcggtcaggagcaaggagaaggcacacatctcgggcctcatttctgtccccgagcgctcccccacactgcgagatcatggcggtggaggggagtcccgcatcctgacccccggccgccgcgcactggggggccctcaacctctgggttacttgggggcacgcagtagccacccacggggcagaaaagacgggggcggtcaactttctccactccagccgcctggggtcccgccatccctcagccaggacgcttggcagccgcctctaggctaggtggccacgagttgcgtgcgagagcgagggctgcgcatgtgcgaggcgtgcgtggtgcgtgtgtggcgccgcgggcttccgctccgacgtggggatcactagacagcaactgccccccaagttctcgtatcagctgcgggaaggagagaatggttctagtcaaccgagagtggaaggagaccaaatttcagcaaatgcacggacttgagtcctcatgagcagggtggccatggtgcggaagcagctggcacggccccctcaaccccggacccctggggtcctcactgccgacccgcgcattcagtgctgcgcataaataagatttccaattagaaggcctaggtcccagctctgccccacagcgtggctttgggccaggcacgtcatagccctggaactctttcttcccattgttgagatgaagagggtgcacgatatgttcgacgcagcaaggttaaatggaaggaaacggggcggccgcttaatgactggttgcacgcgcttgcgttgggtgctgcagcctggtgccaggaaggtggggcagggaccttgtggtgtaaggagtggcggtgaaagtgcctggggtcagagaggagaggcaggggatgagttctgagtgggaggagggggcagctcaggtttcgtcaagtagatgacctctgaaccagaacttgaaggataagacgggagatggccgagacgagagatggccctaggagcatcctggcacagcaggtgcctgaaagcctgcatagggcatagatgtgtctagagagttctgggaatgatcgctagagcggtgttgggctcgtagggaggcaagaggtgggcttggagcgggaggtgggaaaggcatggggagtgtcttgaaagcccccttcatctgcaggtcctgaaacgctgcagagggtctttaggcgtggaatttacataagatgtgtgtttcagtaaagtgacttacaggaaccagacaggaattgtaattatacaaaggggatttcggaggaaggaagttagtctcagtccagggaataatgagggcctgagctcaggagtgcagtggggagggagaaagaaggattccagagagattttgggcagagtaattgacaggctcccgattagagcagaaactaagatgatgcctaggtttggaaaactgggtgaattgaatcattaagacactgaagtgtccaccaagtgcagaccttgtgccaggcactcagcatccaaagatcaaaaaagacctagtctctgccctcaggtgcttctacttgaatagggcaggtggacacataactaggtaattgtatctataccctgtgatgttgaggattacagctgtccctgcctgacctggacctaggggtgagggcaggggggcttcctagagaagtgggacctgagcttggcagaaatgggagttcacaggcagtgtgagatgggtcccctaggtacagtaggaacgcaagcaggaaggccagggagtttgtgatgtgtttggagaactagaagcagatgctggagtgtaaaaccggagcttgacttttattctctagagggtggggagccattgcagagccttaggcagagaagggcctggtcagatttgggtttagggcagcttgccctggtgcctcgtggagaacggttgtaaaggcgagaagctaggagcgagaggtggctgtaggaagtgctggtgaaagagagtggaagctggagctgacacagggagttcaggaaggagagtgggctgggggatggtggggtggggaagtgcaggatgaggagggagggctgaggtgaggtcagtgctgcacaccaggtgcatgaggcctggggagcatctccatggaggtacctaatggcaatttactagccaagtcatcttgaccagttcacttagccttggcgatttgcctcatattgcagaatgtggatgacaagacctacctcataatgttggagtgattcactcaacgagtatttactgagtatctgttggtgttctgggtgccagggattcagctggatggcctcagcagaaaatacacaggaaatatgggttgagctaaaaatcaagggcccaattagaacagatttgactatcatccatattaacactcccagaaaagagggagatgagcagagagagagagagagagacttttccagttgcaaggcaagagtaggctgcagggtcaccttgtgctggctggcaggagccaggggctggcatgtatcctgtttggccaaaccatcattaagtggcagttcgagaataggccctctaagctcttgcactggtgtcataacatctggggatttcctgtgtgtcagtgtttgtgtggatagagggagctggtggtaagtgttcagccaggtgcatccaagatcccagggtctcatgggaggacccagggctggaactggcctcctcataccgctgtacagctctgcctggagcctggagcctcctcctctgctgagtggtgctctcagcacaaaatgagtgttatcaaaggggcatatattctgcactcactagctgcacaagagaagaacagcggttgttggtatgccttataactactcttcagaatacacacccctttgacaacattcactttgttctcaaccataaacaaccacaccccttgtttatggttgagaagatgaaggcctggtggaattagcttcttgccagagactacactgtggccagaaggactctgccttttccttggctatctgagcttcatctcagaggtgtttaattgctccagccagatccatgtgaatagcaaattaagcccacacagtggctcatgcctgtaatcccagcactttgggaggccgaggtaggcggatcacttgaggtcaggagtttgagactagcctggccaatatatgaaaccctgtctctactaaaaacacaaaaaaattagccaggtgtggtggcacacgccagtagtcccagctactgaagcggaagctacatcgagttgagatcgtgccactgcactccagcctaggtcacagagcgagactccatcttaataaataaatagcaaattaatgttttaagtgaagtaacaataacggtttactctgatttaatttacaaataaacatggagtttttgtttataaattttcaccaaatttaaaatcttcaaaggctaattaaaatagttaatatttattgagtgcttcatatgtattttctcatttgattttcacaacatccccatgagttagatatgattatcattgccattttactgaaagtaaggttggagcaaggtggagtaggatggagtaaggatgaggttaagggtggagtaaggttggtatacggtggctaaagttggggtaaggtaaaataaggttagggtaaggtgggataaggttgaggtaaggcggagtaaggttggggtaaggtgggctaagatgaagtaaggtttggcaaagttggggtaaggttggagtaagatgagtaagggggtaaggttggagtaagcttggggtaaagtgggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaaggtgggataatgctgggataagatagaacaaggttggggtaaagtggggtaaggttggggtagggtggcctacagttggagtaaggtgaggtaaagttagggtaaggctggggtaaggtggagggtaacttttcagatgtgatactgtttttgcacgccttatctttcccttcttgctgctcagttaggagcagcttttctcctcaatttaactgaagtgagcatttgctggagaagttgagggaacacgcacattgtgcagccctgtttgtctgagctgaggcttgtgtttgtcctaggaagggccatttgggagctgtttgagatggcatctcacagcgagcagaggagggcacagtcagggtggtgattggggtgaaaactctgctcatgaagaatgatttggtatgtgcacagatgatagcttttctaaatcctattttgtttttctgaaaaataagtgacagtaacctgaacacctttgagtttctccaatgctggcttagtctgaggctggggcctgcctgccatccctttccctctctcactgagtggctgctgcttgcccgtctctgacctttgagagtctcaggtctgatggtggtggagatggagcacaggtgactgattcgggggactcggagacacaccccttggaggagggacagggagggttggaggtagctggtttcatgtgggcagaacacaggacatagacatcctctgtcaacgttggtcttctctgtagtattttgtgcagggtcctggtcagtaaatctggccaagtgagtcatctgaaagcagtcatgtgatctgtgttgataagtggataaagcattggctttcatcactctctggatttgttagtgaactttaaaaaagaaacctttcttgtgcttttaaataatgactgtgttttttaatcttaccatttaaatctagttttcctgaagatgcctgtgtgcctttggccaacaggatctttgtccgaggtgacaatgaagatagtataccatgagcccatactgcctgcagagtcgtggctgccaaaattaacagctgtggaattatttgtgaccctgttaaggataaacatatttgtcccttttcattttatgatcagcaactgctaaagttcttacttgtaattgcaatttactgccctcactgtattgcttagtttagaggtggacacagaaagaatggaacatttgttttcttttgggtctgagctatgaatttgggccgcattatcatgcaggccttggcccctctgtctctgcaagattgggctttcctgtttttgtcattctcagcttacttcgcaggcatgctttgtgtagaggagaaaaataccctccaaagaacctcccaaggaggttaccaggtacacggttcagccaagtgggtgactcaatgggatgcatctctttgtgtttgtcagggccgggaagggtgtgacagcatgtggggagagactcagttcccagccaaataactttaccacctgagctatgaggcagttcctgcacatcaccactccagcagggtccagccttgctgcggcagaaagcgagtgtgtgggaaagcaaatggctccacacgacgcttgcagtgttcagagggatgagtatgaattgtgtgtatctcagggacccctttgacccatgaatacatgtatagagtattctctattatgtgggtgaagtgtatctacttacatacttaagtatttgtgagtaaaacgagaaaaaaaaaagatgtgaaggatggatagagaaaataaaacagcaggaggctggtagttcctgaggctggatgctgggcacatgggcatccattctactcttctctctatacttctgtgtatatttgaacattttcaaaataagaggttttattttgttttttgattttttttttagatggagtctcactctgtcgccaggctggagtgcagtggtatgatataggcttactgcaacctccgcctgctgggttcaagcaattctcctgcctcagcctcccaagtagctgggactacaggtgcgtgccatcatgcccaactaattttttttgtatttttagtagagacggggtgtcaccgtgttggccaggatggtctccatctcttgaccttgtgatccacccgccttggcctcccaaagtgctgggattacaggcgtgagccaccgcacctggccttttctctttctttctttttttttgagatggagtctcactctgtagcccaagctggagtgcagtggtgcgatcttggctcactgcaacctctgcctgtggggctcaagcgattttcgtgcctcagcctcctgagtagctgggactacaggtatgcgccaccacacccagctaattttttgtattttagtagagatggggtatcaccatgttgcccagggtggtctcgaactcctgagctcaggcaatccacctgccttggcctcccaaagtgctgggattataggtgtgagccactgtgcccagacagaatcaaaggattctttttttaagtatgtacagtatttgtcttagtctattgtgctgctgtaacaagatacttgagacagggtagtttataaacaacagatatttatttcttacagttctggaggctgggaagtctgagaccaaggcaccagcattcagtgtctggtgagggccttcttgctgtgtccccatggggcagaaggcagaagggcagaagggcagaaggcagaagggcaaaacctgcctcgctggttccttcaagccgttttacaaggtcactgatcctgtttatcagggctccccctgcagaacttaatcacctcctaaaggccttgtatcttaatgctgtcacattggcagttaagtttcaacacatgaattttgggggcatccaggccatgacagttttcaaacatttttctgcatatgtaggacccatcaaacgctgtactcctgctctggtgcacacactgagctgggcatctgggttcaacaatgcttcactttcctggcacgcagagctgaggggcagggacagagatgaaatctctgaggcacagtgatggtatcatggaaaccttgaactgaggggagggtcggagttggtttcactgaggaatcgaggactgagctgagaaccgaaggatgactgggaacctcctgggtgctgtgggactgggactgggggcgagggagagggagtctcagatggtgggaatcccctgtgtagtggccctggggcctgatggtggccagaggatggagcccagagggaggggaggatggtgaggcaggggtggaaggtaaggggtgttccaggcccggttaggggattggccttggtattcgtgccatggacagccattgaggcgtctaagcagggagtagccacagatcaggctcctgttttccagccaccgtttatttgtggcttggaggatggatggcacaggcaggcactggcatccaggtgagagatgacagctccccagactgaggctgttgggggtgtgtggtggcaggagtgggagcagaggtgtgtttgagagagatggaggatgtagtggcggtctaggcatgggtcatggggaggaggggtgagcataaacggtgatggagccattgcagagatagaacgccagaacaggacctgatgtggaagggaagaccaagccttgtgtctgacttgggtggatctggagggagattttgcaaagcaacttggtcatgtagacttggggctcagaggaggcccctgggaaatgagtctgagggactcctccgcatgcagacactactgagagtgtggaggagttgcttagggagaggtatgagccaagggaccacatgaggtggctccagcagactgttgagccccagctcgggtctttttaaaattaaacaagccacacttaggtgtgcttgttgtaaagatgtgaagccatagctactatatacagatgcagacacttgcagacacttttctagacagcacagctacacgtatgtacatatgcatatatattattttccgttttatgtaaatgggatcataccatcatcccagcaactcatttttttgaaggtttgttttctgattataaatgtcatgcaaaggtataatgggagtcctctcctaaaatcccattctccagagataacatcattgttaacatagtccttaaacgttttcttctatacctatatagtattttattatatggatgaatcattatttataattattcctctgtggaagaacatttaggtgcctgtaagttttcttctgttaaaatatagccctacagtgaacattcttgagtgtgtgtattcacttgtgtgcatttgtgagtagttttgcaggctgggctcctccaagtggaattgctaggctaaagggcatgtaccttttagaggtttttgtttgtttgtttgtttgtttgttttttgagatggagtcttgctgtgtcacccaagctggagtgcagtggcgcgatctcagctcactgcaacctccgcctcccgagttcaaacaattctcctgcctcagcctcccaagtagctgggattacaggcatgcgccaacaagcccaggtgattttgtagttttagtagagacagggtttcaccatgttggtcaggctggtcttgaactcctcctgacctgtagtgacccacccgccttggcctcccaaaatgttgggattacaggcatgagccaccacgcctgcccaaccttttagagttttaacagatgttgctccgtggcctgagaatgcctgtttccccacactttctccagcactagatttaacctaatctgttgggtgaaaaaggttgtcttattgatgccttaatttacattctatccatgacttgcaactttaagcatcttttaaaatgtttattggttacaggcaatcttcatgagaacattgtatcctctgtctgtttttcttttgggtttcctttatttttccttaatggagttgaaacagttctttgcaggatctggcagttgattgacagcttcttaattctaagaatgcccccaacttaaaagcagccctggagggtccccttcttccgtgtcacccccagtgtcttgtgtgagttgtcaccgggccccacttgttttcctctgaagcattctgacagctctgctcgtggcccctgcgtttaagagacatgctgggccgggcgcagtggctcacgcctgtaatcccagcactctgggaggccgagatgggtggatcacgaggtcaggagatcgagaccatcctgcctagcatggtgaaaccccatctctactaaaaatacaaaaaattggccgggcatggtggcaggcgcctgtagtcccagctcgggaggctgaggcaggagaatggtgtgaacctgggagatggaggttgcagtgagccgagactgcgccactgcactccagcctgggtgacagagagagactccgtctcaaaaaaaaaaaaaaagagacatgctgcaggccaggcatggtggctcatgcctgtagtcccaacactttgggaggccaaggcgggcggatcacttgaagtcgggagtttgagaccaccctggcaaacatggggaaaccccgtccctaccaaaaatacaaaacagctgggcgtggtgcctgtaatcccagttaactcggtaggctgaggcaggagaattgcttgaacgcaagaggtggaggttgcagtgagtcaagatcatgtcactgcactccagcctggacaagagtgagattctgtctcaaaaaaaaaaaaaaaaagagagagagagagaaacatgctgctgcagagcacccctgcagtgttcccgaggtgtgaggtgacagagccctagtctctgattctgtgacagcttcagagggtgacactctgtgtcgggcccaaaagggctcccctgggctgtcagtgatgagcttctctggtcacctttggggggtgccgtaacctcacctctgttcagtttctcagatggccagtcagggaaaagagtggccatcaacatatcatgaaaatgttctatttgaaaatgcagagtacagttcctggggacacggggatctcccagtgctcggtgcttcaagaccctgggcagttcatattagacaatgtcacaggaaggtgtgagtcattctgggcggttgctagtgtgccgtgcctgtgggcttggtgctggggaggccaggcaggcttggtggtggggaggccaggcgtgggagtgatgctcctgactatgccttctctcccagtcactcctttctgggttttgttaggggagggggtgtctagggcccaggccatcaccagaagcttggccccctgctcttgcttctgccaaacactccacagttcagctggaagcgccctcagggttgtccaagctgcctgcagttggttgtgcctccgactggctctggccccgcctcccagcctccgtagctggttcctgagccctactcctggggccgccagcctctcctacttccctcctctctctctgcttgctttgcagcagctttactgagatatgattcacataccctacaattcacccctcggaagaagagttcttagtagagttttccatcatttttagtctgttcacagagttgtgtaaccatcaccatccagtttagaatatttgcatggccccaaaagaagcccagtactcatgaatcagtcactcccatttccccctcacctacctcctctctcagcctctcccagcctctcacaaccaccagtctactttctgtccctatggatttgccctttctggacatttcatgtaagtggaatcagatggtatgtggccacttgtgtttagagtggtgagcagagcccaggctgcggcagacatccagaccaaggcggtctgggccaggtgacagcctggctagggtttggcgaggtcagttcctcctgcctccgtggggcccatgagccgcagtccccagggatgcatccggagggcatcagaggcaggacgccgagcaagctgatacccaaggagtcacagccaccctgggagcttaaagggccgatgcagggattgggaggccgtggtctgggtcagttgggaactgggggtgatcagggatggccactcatagaacctctggatcctgtaatctagagagacacggaacatgagctcccctgttggtgtctctcctgaacccattccctcaatatagacacgcttctcctttgatgttgtagacagtctgagatatattctactaattttaccagttaggctttccgtgaattgatgccttgttaaagttctctagagggttttgacattcattttcattcattcacatcttagggtgaattattttaatctaggtactttcttcctaacagaagaatcaagttaatgaaactggaagtccctagtctccttagatttcataattggcctcacaatgtcacaagaaccctgatcctggcactcgtcctatcaggtgctgtgcaagggaagcgctgtgagtgacagagcaaagccaggcatctttcagtcaaggattttctctccagttgtgtgcaagataagaagtgactgactctgtgtagccaggaggctgaggcaggaggatggcttgaggccagcggtttgggaccagcctaggcaacatagtaagactcggtctctacaaaaaatttaaaaaatatccgggtgtggtggtgcgtgcctggggtcccagctgctgggaatgctgaagcaggaggggattgcttgagcccaggagttcgaggctgcagtgagccatgattgcaccactgcactccaatctgtgtgacagatgagaccctgtctcttaaaaaaaaaaaaaaaccaaaaccaaaaacaaaaaaccacctctctagattatgttgctcctctgctccacaccatgctgtggcttctgttcacagtcaaaggtcccaaagtggccatggcctgtgctgcctgctgccgctctccacaccctggccgctcggtccccaggagaccaggcatgctcctgccacagggcctttgcactgggtgctctctgggtctggaacaggccccacacccactcacttcccccaagtctgctcagatgccacttccacacttcctaacaaaaggaagctgttggtgagcagatgctcagtaacttatgtgtggccagaaggagcgagtggctccagcctgcgcgtggaaagctggctctcctgggtcactgctctcactgagcctcgggtttctgctgcccagaggactgcgtggctctttcttgtacctggcagttctgacactgctggaattgggaagaaaagggaccctgagactaggtcactccctcctggggtctcaaggggccctgtccctggggctggaggctgagcttcctcctccttgtccccaccctggggatggcctgtgttctgtcttccttgtgctcaccactggcgcctgttggctgaggcaagagggcctccagctgggttcttcctgtcctctagttggtgcctgaaggccccagttgggtggggtctctctttaccctctggtcatatagcaaactgtggctggtgtgtggtgagtcagccctgtgtgcaggcagggtcccatttccctgtgtgcaggccacagtctgtcccagtgcctgcaaggcctctgccccagctggcctggaccccccttgccagactctgctctttgtggggctctgcccacatctactgcccagtaggacgcccagtctccactgctctttggaggtaaaagagggcctggcacactggcacggggtactttcccaaaggtcaaagatgtgttgagtgaacgaaggtagagagttcatttctgagacctttgctggcctaattcagctcagtggggtgaagttattactgttgagatgcttgctgttttgattgtctttagagagcattcttaatatttggatggtttaaaataccaaggagaaaaaagggaggagaggcttcttttttaaaaataccaacttcattatgaaaacacacaaatgtacacacaaatagaataatataatgacacccctcccaccaccacacggcctgtttcagtctgtgtccacagcgaggcttctgaaggaaaggctgtggagggggtgagctggtggagcccatgttctcccgggcctggccgggatgtgcttgccgctgtcacagctcccccatctccacccgtcacatgacatcgaatgaggccggcctggctctagccactgcacaggtgtcccgtggtcatttccttcctgtgctgctgaggcacacagtcacccgtttgcaaactctgaggtgttttcccttttcccatttcctgtcactgttttgaagctgtgagaggaagagagagacctcgatctgataaccattcatttactatcaaagttggggtcacatccttataagaacgtgtggcttgaggtcatgaatagcagtaatgcgagggaagctaagattctggcaggatgcaaatgatctgggagttttcattttgtcgttatgtatgggctgttttctgctgcattgttaactattggaaaagattttccatggattattatatggattatagaggaaaatgcaaatctccaacctctatacatttaatcacttaaatgaaatgtcaagttttcttgttaagaattatggtgctgactggaagaacaacatggctttaaatatgacttattagtttctttccacttctaaagttcaaaataaaacatcataggtggcaaaacaaatcaaggtaaaatacgttttgaaaagtcataactttactcaacaacaaaaaataagaaatagacagaggacttgaatagacatttctccaaagaagacatacaagtggccaagaagtacatgaaaagatgcccaacatcactggttattagggaaatgcaaatcacaggcattaggatggctattatcaaaaaaagccaagcaaaaccaacaacagaaaataaaagcattggcaaggatgtaaagaacgtgaagatgtggagaaattgaacgttggtttactgttggtgggaatgtaaaatggtgctgccaccgtggaaaagtttggtatttcctcaaaaagtgaatcagaggccaggcgcggtggctcacgcctgtaatcccagcactttgggaggccgaggtgggcagatcacgaggtccggagatcaagaccatcctggctaacacggtgaaaccccatttctactaaaaataaaaaaattagctgggcgtggtggtgggcgcctgtagtcccagctactcgggaggctgaggcaggagaatggcgtgaacccgggaggtggagtttgcagtgagccgagatagcgccactgcagtccagcctgggctaaagagcaagactccgtctcaaaaaaaaaaaaaaaaaaagtgaatcagaattaccgtgtggtctaggaattccacgcccagaataggcatgcactgaaaagaattgaaagcagggactcaagacacttgtgcatcgatgttcacagcagcatcattcacgctagctaaaaggtagaaacaattcaaacatgcaccgacagataaatggataagcaatgtggtctacagacatggacaatggaatattatccagccttaaagaaggaactctggccggtcacggtggctcatgtgtgtaatcccagcactttgggaggccgaggcgggtggatcacgaggtcaggagttcaagaccagcctggccaagatggtgaaaccctgtctctactaaaaatacaaaaattagctgggtgtggtggcaggtgcctgtaatcccagctactcaggaggctgaggcagagaattgcttgaacccaggaggcagaggttgcagcaagccaagatcatgctactgcactccagcctgggtgacagagcaagattctgtctcaaaaaaaaaaaaagaagaaggaattctgacacatgttactacatggatgaatgttgaagccatgcccggtgaaataagccagtcacaaaaagacaaatattgtctgatttcacttatatgaggtatctcttatataaggtaatcaaattcatagagacagaaattagaatagtggttaccagagggtggggaagcagggaatgggaagttattattgaattagtatagacttacagtttgggatgacaacaaagttctggagatggatgatactgatggttgtacaacattgtgaatgtgcttactgccacagaactgtacaattaaaatgattaaaatgatccttttggccaggcgcggtggctcatgcctgtaatcccagaactttaggaggccgaggcagatggatcgcgaggtcaagagatcaagaccagcctggccaacatggtgaaccccatctctactaaacatacaaaaattagctgggcatggtggcacgtgcctgtaatccccgctactcgggggctgaggcaggaaaatcgcttgaaccagggagtcggaggttgcggtgagccgagatggcaccactgcactccagcctggtgacagagtgagactccgtctcaaaaaaaaggatccttttgtgctgtgtatattttaccacaattaaaaatgcaggagttagtaaaggaatggaacaagatcatgtgaacgtgagttatgagaatactggaatggcatccggcaaagcagactcagaacaggactgttcctagagatagggaggactgttttatgcggataaagtggtcaagtcatcaagaagacattatgatcctaaatatgtatgcacccaatacagagcaaaaactgacagaaccaagagaacaaatagacaaatgcgcagttatagctagagatttccacacttctctctcagtaaatgacagaacaaggaggcagaaaatcagtttaagaatgcagaatactgcctgggtgcggtggctcacacctgtaatcccagcactttgggaggccaaggtaggcagatcacttgaggtcaggagtttgagatcagcttggccaacatggcaaaaacctgtctctaccaaaaatacaaaaattagcaaggtgtggtggtgcatacctgtaatcccggctacttggtaggctaaagcagaagaattgcttgaacccgggaggtggatgttgtagtaagccgagatcacgccattgcactctagcctgggcgacaagaacaaaactccatcatgacaaaaaaaaaaaaacaacaacaacgacaaaaactagccaattgagttgggcacagtggctcacgactgtaatcccagcactttgggaggccgaggcaggcagatcgcttgagctcaggagatgaagaccagcctgggcaacgtggtgaaaccctgactctacaaaaaatccaaaaaattagccatgtgtggtggtgtacacctgtggtcccagctgcttgggaggctgaggtgggaggatcactgaagcctgggaggtcaaggctgcagtgagcagagatcgcgtcactgcactccagcatgggtgtcagagtgagaccctgtctgaaaaaaaaaaaagtcagttgaatctagcaacaaaaaaaaggataggccatggacaagtagagtttatcccagtaatgcaacatcagcttaacatttaaaaatcaatataatcctccatattaacacaaaaaaagtaggaaaacactatcaataaagagcagaaaactgatggtacaacaagtggatgaatctcacaggacttatgttgaatgaaagaagctggacaaaacagtatgcactgtgattccttttatagaaaactctagaaaggacagatctcatctagaatgatggaacacagatgggtggttccctgggtcctggtgtgaccaggaggagtcatgagggaagcttctggagtgatgggatgttcttggttttgactgtgatgatggttacttacacaggtatacacatttgtctacatgcattgagctgtatacttttatttttttttttgagacagagtctcactctgtcacccaggatggagtgcagtggcacgtcttggctcactgcaagctccgcctcccgggttcacgccattctcctgcctgaggctcccaaatagctgggactacaggcatgggccaccacacccggctaattttgtttttgtatttttagtagagacggggtttcaccatgttagccaggatggtctcgatctcctgacctcatgatctgcccacctcggcctcccaaagtgctgggattacaggcgtgagccaccatgcccggcctaagctgtatacttaagatgtgtgcactctctcgtatgcaagctgtacatcaataatattgatttttaaaaatcctttaactgaggtaaaacactgatgtacagtgtagttattctgcattttctgaaataaccatagtttatatcagaaagaatagggagctacagaagatacagaatagtgcatataagttgctactttttattgataaatttttacatgtttatgtggtacatggagtagttgttacattacacattacagaatatgtaatgatcaactgagagtatctgaggtatccatcaccttgagtgtttctttcttttttcttttttttttttttttgagagggagtcttgctctgtcacccaggctggagtgcagtggcacgatcttggctcaatgcaagctctgcctcccgggttcacgccattctcctgcctcagcctcccgagtagctgggactacaggcgcccgccaccacgcccggctaatttttttttttttttttgtattttttagtagagacggggtttcactgtgttaaccaggatggtgttgatctcctgacctcgtgatctgcctgcctcggcctcccaaagtgctgggattacaggtgtgagccaccgtgcccggccttgagtatttatttctaagtgtttgtaatgaggtaggaggcaggcgagactcaactccggaccagattgaggactggccaaaactaggaagaagtgcacaaaggacctctccataagacatgcccaccagtgccatgacagtttactattgccatagcaacacccaaaacttaccacccattttctagctgtttctgaataacctgccccttaattagcatggcactaaaagtgggtataagatatgactgcaaaactgcccctaggctgcgaccctcagcacactgcctatggggtagctctgctctgcaggggcagccagccagagctatagcactgcctccaccgcaagaaagctgttttcttccactaccagcttgctcttgaattccttcctgaggaagccaagaacctgccctgcatcagtagcatttcaagtcctctcttctagctgctctgaaatatgcaatacattgttgccagctacagataccctactaccctgctatggaatgttagggcttatttcttctacctaaccatatgtttgtacccattagccaacttctctttatcctcctcccacccacacatgcttcccagcctctggtatctatcattctattctctccctccatgacatcaactttttagctcccacatatgagtgagaacatatggtagctgtctttctgtgcttggcctatttcacttaacgttatgatcatcggttccatccatgctgctgcaaatgacgatttcattcatcttatggctgaatagaattccattatatatatatttatatatatatatatatatatatatatatatctatctcacattttctttatttcttcatctgtcagtggacacagtttgattccatatctttgctgttgtgaataggagagtgctaccactgttaaaggatctatttacatacatgcttataaataaatgcatccaggatttttgtaaagatctatcattactttcactcttttgtagcttttgaattttttcatcatgtgcatccacttcctaaaaacaaaatttctttttttaacttttcttttctttttctttttttttgaggcagggtctcattctgtcacccaggctggattgcagtggtgtgacctgagctcactgcaacacgtacctcctgggctcaaacaatcctcctacctcagcctcctgagtagctgagactacacactcatgccaccacacccagctaatttttgtattttttgtagagatggggttttgttatgttgccaagactgctgtctaactcctgggcacaagcaatctgcctgccttggcccaaagtgctgggattacaggcatgagccaccgcacccagttgtgtttttttgtgttttgtttttgtttttgtttttgttttgagacagagtctccctctattgcccaggctggagtgcagtggtgctgaaacaggaaaagttcccgtgtccccctcgcagggcaggcgatgggggtgtggttcgcttcttcagtgccccactgctcaaaccgctaggggagcatacagatgggcaggctgtggggctccggccccagggcaatgtctaggggttaatgtttacagccaggacccagtgggcatgtgctactgtttgctcttttagttttgctgtctataggtggcttttgttaaccagttcaattagaccctctaggcctggcatggtggctcatgcctgtaatcccagcactttgggaggccgaggtgggcagatcacttgaggtcagaagttcaagaccagcctggcccaacatggcgaaaccccgtctctacttaaaaatacaaaaattatccgggtgtggtggctcacacctgtaatcccacctattcgggaggctgaggcatgagaatcacttgaaccccagaggcagaggttgcagtgagcagagattgcaccactgcactccagcctaggcgacacagggagacaccatctcaacaaaaaacaaaaaaaaaaaacaaaaacaaaaacagaaaaaaaggaccctgtaccttgttgcgaggacagaggacttcctgtatccgggtttttgacttggtgtaccggaagaattggatcacacgtgggcttggagaatgagtgcaaggttttgttgagtggaagtagctctcagtagatgggggagccagaagggagatggagtgggaaggtggctttcccctggagtcgggtcgctcagcagcccaggctctcctcgactgccctggccaaactccacgtcgttccaccagtcgagagcctgccagtgtctgccagtgtgctcttctgccagagtgctcctttcaacatcctctcaaagtccagcggcttgcgtctccttctgccagtgtgttcctcatgatgtccagccacttctgtgtctgcctgctagggtcttgggggttttcataggcacatcatggggatgcagcaggccagggcattctgggtaaatgcaatgtttgggcaggagtgcctatcctcacctaggtacatagtggtggagctctagccagggaccatgccctcctctacccagcacttctcttccccactcctgtatcatttaaagggaccacgctgttcccttcccagcacttcccttccatatcagcgctatcattagctccctgcagccacaaactcctgggctcaagtgatcctcctgcctctgcctcccaagtagccaggactaaaggcatgtgtcaccatgcctggctaatttttttaaaaagttttgtagagatagggtcttgctatgttgcccaggctgaattaactggactattgttcaggaaaccaaagtaccaggcagtacaatgctagatttgaagtctatgaaaatagtaccctctgaatcattaaggcgcatcttcctatgagaggtggcttgagccagaccctggtggccaggggcagtgtctgtctggaccttcccaccaacaggctgtgcagccctggccagcccctattgctcctgtactctttccttacctgctaaacacacccaaatcacagcagaaatccaattcacttgaagacaagggctaagcctttctcataaccaaaggccgtgcgcttcccagagcaaaagtctgtatttgtcccctcatgttctgagctgccaggcagtaattctagcctacagttactcagtgtgacctaaaataacaattacccaagaaatgaaattctgataatttcaagtagaataaaatggaacatattttagtgaatggattgtaaggaaaagcctaaagatttggaactgcccatacgtggcactttaaaaatcttgggccctttatttcaggtaatcagttcatagagtaaaaacccatgtgactgccaagactggttattagttcaagcccaagaacacatcttcaaaggaagagaatgaatttatccacagttctgattgttttttacgttctaaaatcacacttattattaaaatataattcacttaatggtgatggtaattacatcagccaattcacttaaaatgaatgcgcaaagatgaatgcacaaaaatgcaccatttttcaatgaattggctgatgtacttaccgtcaccatcaaaacgcagggtgttcccctttccccgggaagcttccttgtgctgcagtctctgtcaaatcccttattcacagacctggccaaacactggtcactagagattagatttagctttcagggtttcacagaagtggaatcattcactctatgctgcttcttgtctggtacctttcgctcagcacaatgtttttcagctttatctgtgttgttacatgtgccaaacctttattcctttgtcgttgttgttttgaaacagtcttgcttcgttgcccaggctggagtgcatcggtgccattgtagctcactgcagccctgaactcctgggctcaaattatcctcccgcctcagcctcccaagtagctgggatgacaggtgtgtgccactgtgccctactaattttttatttttattttattttattttattttgagacagagtctcgctctgtcgcccaggctgagtgcagtggcgcaatcttggctcattgcaagctccgccttctgggtctacgccattctcctgcctcagcctcccgagtagctgggactacaggcgcccgccaccacaccaggctaattttttgtatttttagtagagacggggtttcaccatgttagccaggatggtctcgatctcctgacctcatgatccacccgcctcggcctcccaaagtgctgggattacaggtgtgagtcaccacgcccagcccattttaattttttttagagatggggtcttaactatgttgcccaggctggtgttgaactcccggcctcaagtgatcctcccaccttcgtctcccaaagtgatgggattacaggtgtgagccactgcacccggccacatttattccttttgatcgctgaacagtactcctcaaatgattttttaaaaataactatcttcttcctcatgacctgctggtaactcctagaacagtgatggaggagaattatggaatggtccttctaagctcctgaataattaaaccagtgagcagagccactgtcccatcccgttggccacaccagacacttgggaattatttttggttccttcttctacctcttttcaattccaataattaccaagttctatcaattttaatcccctaatatctctctaatcgatctcttcagttgctatttaagtaactcttcatttcttctcacctgtgttactacagaaattcatttttctatagttttgccttccatcaatcccttctccatcttaaaccaaactgatcttactgagaggaatgttgtgatttcctctctctctctctctctggaatgaatatatacatacatacatatatatatatatatatatgtgtgtgtatatatatatatatatatgtgtgtgtgtgtatatatatatatatatatatgtgtgtgtgtgtatatatatgtatatatattccagaaccttttcatcaccctaaagagaaactctgtccctaaatcccattccccctcccctagcccctggtaaccaccaaccaccatctcactttcgctctacaaatttgattattctaggtaccccatataacgactcgtacggtatttgtccttttgtgtctggcttatgtcacttagcccaatatttttcaggtttatctatgttgtgtcatgtgtcagtatcaggatttcatctctttctgaggctgaatgatgccccactgtgtttatccattcatctgttggacacctgggctgcttctatctcttgctattgtgaagaatgctgctgtgaacatgggcgcacaagcttctgttccagttcctgctttaattatctagggcatacacttaggactgggattgatggctcatatggtaattctgtgttcaaatttttgagaaaccacctaactgttttccacagcggctgcaccattttgcattcccacaagcaatgcgcaaaggttccattttctccaaaactggatacagtgaacaacaatgaaggtttttggttttaaacatatatacatatgttgtttatatgctctacacacatctctgtgtgtgtatcttaaaatgggtgccagtgactcgccattcagttttgggcaacgtggactctcggtgcctcagtttcctcacccctaatggaggtactgatactgttatcattcttgaagtgattgtgcagtttaaatgagcaaatatatgtaaatgacttaagtgggacctgacaaatgcagatgctataatgtaaggatggctgatctcattattgttgtcatactattactgaaaatcagtgtgaatgaaatctctaaactttgcaatcaacactgctcacctgggtctccgtagaagctgcagcgagctggggctgaggcagacaagcctgtggacatgagaacagatgcatgtgctcctcagacagacagacagtagggtgttgtggaaggggtcatctttagaggccacatactgtagtccatctccctcacagagcaggaaggtgaagcttgccaagcctgagggaatcctccagcccagacatcctatgagggcattgccaggacttgggggtagtgccctcgctccaggcatgtcttttccccatcccttgagcaggaagaagcacagcagacagcagggtgcatgcagagtacctggcagaatcgcctcggtagtgagaacaagcctgcgtgatgctgcaggtgcccctgactgtgactgagcctggcttcacacacctgggtttcctcatggctgttttcagcaatttggttactgtggtcccaggatgcatagcctctcaagattccacagaacagcctggtccagcatgaaggctacacggtgcctggtgccatctctcaacgtgtttgttaaaagggaagctttgtggcctcttcatctaatatagagggccttcaaattatagacttccaagtccatagctatagagattttcattttaaaatatatgtattggctgggcataatggcttacgcccgtaatcacagcactttaggaggccaaggcgggaggatcacttgaggccaggagttcaagaccagcctgggcaacagagtgagaccctgtttctcctaaaataaaaattaaaaaattagctaaggatggtggcatgcacctgtagttccagctacttgggaggctgaagtgggaggatcatttgagccaaggagtttgaggctgcagtgagctgtgatttcacactgcactccagcatgggtgacagagcaagactctatctctaaaaacaaaacaaaataaataaaatacagtaaaaaatagtgtgttgtgttgtggggtctgatgcggatgtctacagctcttcattcctaatgcatctgctgtttttccagctccccctgaggccacgggccacacaggccacaggggctctgcctgcccagctgggtccacaggaattctgccaagaagggctttcttttgcccttgtgggagctggtgggtcacttcctggtttttttctcatgattattgtttgtgaagtttgaatagaactgactcctggcttgttttttaattattaaagatttaagaacttttgaaaagattaaaaaagaattttgctcatattcctgccagccttgcataataattgttttcatttctatagacttttttctggtcttttctcatgctgacacagattttacattgttgtaatcattgtgtggggacaatttaggttctttcttctcagttttgtttgtaaacatctctttcatatcacattatttattattattattatttgagacagggtctcactctgtcacccaggctgcagtgcagtggtacaatcatagctcactgcagcctcaacctcccaggctcaagccatccttctgcctcagctccctgagtagctgggaccacaggtgtgtaccatcatgctcggctaatttttacattttttgtagagatggagtctcgctatgttgcccagactggtcttgaactcttggcctcaagggaccctcctgcctcagcttccacagtcctgggattatagacatgagccactgtgcccacattatttatttttgacagccaaatagtaatctgtcaggttaacatactgtaatatattatagagaagagacattcctctctgactggtatttaattttacccaaattttcactatcgtgaattttgtttaactcttcttggttttatgcaatttgtaaaaaatcactgttcataatttgtcttccatgcagttcatgccacagcatttgagagtgggtgctgccctcctccaccgtccctcttctatcagaattccgccacaagaaatgtcctggcattaacattttggaagctgctttagtgagggccactcttggggctggacaaatggctacttgagggtggtatctgccatgaggttggtcaggtacaggggcttggctggcctggcctggtgtggactattccaaggtcacgtcatcaacaacaaggtgggttagctatggtgcacatactccgctaccctaagcagctggaaacctggacaaaatgtctgaatcaactgttttcaggtgttgagaaacaggccatgcagagctgtgaccccagagtctacagaaatgagatggcaaggcgccgcagctgccctgggtttctgccttggtggggtcgggggtgcttcatgcacatcaagcagtgcgagtggcttggctgcattgaggagcggagatggggggctctgaacagctgtggtttgtgggctgagtcctggagggatgggaacactgcagagagggggctccagtaatcctcagggttgccccgagcattgggagatcctaagctgtgtgtgtgcggtgtgcaacgtcgtggagacaggaaagaacgagtgaccaggagcagaaaggcagctgagtccaagagttcacctgttctgggagatgctcgggtggcagccagactcagtggatggctctcactgaactcccgggatgccctagagacccctgaagagccccaccttagtagtggagcaaataagctctagagtaagggtgtcttagaccctcccctgcagagcttaaaacaaggcttcaaagtgaggttggaggcgggccccaatctggaggcttggctcatgcaagggaccaaattgaggcctagctaaacagggagggggcagaagcagctttccctaagatacacccaccagtgtgccatgtcagtttaccattgccatggcaacacccagaattgacctctcctttccatggcaatgaccggacaacccaggagttcctactgcttccctagaaatttctgcataaaccactcgttaatctgcatgtaattaaaagtaggtataagtatgcctgcaaagctgccctgagctgctactctctgcctatggggtccccctgctctgcaggagcagtcacggagctgcaacactgctgcttcagtaaaagctgtttctcctaccaccagcttgctcttgaattctttcctgggtgaggccaagaactcttgagggctaagccccactttagggctcatctgccctgcctcaaaaaaatcaaactagtctgccagtgactttgctgcttaaccaggcttggaagaaaagaaaactatagatcaaggtccttcatgaacacaaatgtgaaaatcttcaacaaaatattaccaaatatgactcagccatgtacaaaaaggattatacaccataatcaagtagagtgtatcccaggagtaaatggttagttcaacattcgaaagtcaatcaacacaattcttcctatcagccaactcaagaaggaagcatttatgatcggctcaatagatccagaaacggcatttaacaacatccaacacccatgtgtgaccaaaacacaggaagccgggaattaaagggaatttccttaatgtgataaaggcatctacaaatgccctacaactagcagcatgcctaagggtgaaagaccgaatacttttcccctaagggccagagcaaggccaggttgtctgaccccatcatttctattcaccattgtactggaggttgtagcaagggcaaaaggtgagaaaaaggaaaggcatacagattggagaggaataaacaaaaccatctttattcccagatgataggattttcagtgtagaaaatccgatggaatctacagaaaagctaccgaaactcacaaggaaatatatctactagcaaaccactgaaaattgaaataaacatgtccatttatgacagcaccaaaacacaaatttggtcatgaatcctataaaatatatgcaagagctacatgctgaaaacaataaaacttggccggtgcagtggcttatgcctgtgatcccagcactgtgagaggctgaggcaggaggattacttgaacccaggagttcaagaccagcctgggcagcatagcaggagcccatctttataccaacaaggaagaaagaggccaggcacagtggctcacacctgtaatcccagcactttgggaggccgaggcgggcggatcacttgaggtcaggagttcaagaccaacctggccaatatggtgaaaccccatctctacaaaaatacaaaaattagcagggcatgatggccggtgcctgtaatcccagctactcagaaggctgagacaagagcatcgcttgaatccaggaggtggaggttgcaatgagctgagatcgcaccattgcactccagcctgggtgacagagcgagactctgtctcaaaaaaaaaaaaaaagaagaaagaaaaagatatataaaaagctataaaatgctgataaaaaaatcaaagaattcctaaataaatggagaggtatattgtgttcttgtgttggaatagtcaatattccaaggtttacaagatgtcagttctcccacactgatctagaaattaaactaagtcccagtgaaaatctctgcaggttttttggtagaaatcgacaagcggactctaaaattcacagagaaaggcaggaagctaccatagacactactctagagaagaatatggttggaggacacacactatctgatttgaagacttactacaaagctacggtcatacagacatggtggtgttggagaaggcatagacagatagatcaatggacagacaggcaggccacagaaatcgccccacatggctgtggtagattgccttttgacagtgtgaggccagtttagtggaggatggattgtttcgggatgaagttcttggttcagagggtctgagactcaaggaggagttctggagcccagagacaccgttttgggaggtgtagacttagagttggaatggaggacgtaggaagatgtgagcttccccagggagatgggaagatggaggagaaagctggggtcctgactctggaataggagagagacaggattaagagagggacctaaaggcggggaagctcacgtctgcacaatggggaacgtatctggggaaggagctggcacatgctgtcaggtgcttctttgagcacaagatggcccaggccggaaaagggatttcagggaggtaaagaaatgcagaagaatgggagagcagggtggagacacaatggtgctgcacatcagcctggtgtcaccctctgctgcacatggagggatgggggtcatgccaacaaacagccatacagttttccttcttagctgcttgttttttttgagacatggtctggctttgttgcccaggccggagtgcagtggcacaatcttggctcactgcagtctcaatctcccgagctcaagcagtcctcccacctcagcctcccaggtatttgggatcataggcatgcaccaccatgcctggctaatttttaaaattttttgtagagacagggtctcactatcttgcccaggctggtgttgaactactgggcctaagtgatcctcctgtctcagcctcccaaatcatgctgagattacaggcatgagctaccaggcccggcctctcaactcttttttttttttttttttgagacagagtctcgctctgttgcccaggctagagtgcagtggcacaatctcggcgcactgcaagctccacctcccgggttcacgccatcctcctgcctcagcctcctgagtagctgggactacaggcgcccgtcaccatgcctggctaattttttttgtatttttagtagagacggggtatcactgtcttagccaggatggtctcgatttcctgacctcgtaatccgcccacctcagcctcccaaactgctgggattacaggcttgagctaccgcgcccggcctcaactctttaaagtaagatctatcatccccattttacggacaggggaactgaggctgggttcctgccgccagcgagtgggacccctggcctttgagccccggcccttcccaccaccctctgctgctggggctcagccctcgggcacgtggttgtgttaatggagagccatggccatgacttggagggcccggagagcgtgcacatcatgcctgcttcccatgatgccctgcgaggtgggcagaggccgggggtgctcaggccgagcccctgctacagcagatctgaggcaccagcagggactggctaggtcctcccaggcaggccaatgtgcccgggtcttgggcctctctctctcactcctcactgcctctcagctgcccaggcagcgtcccctgcagagcagccctggagcctggccccaggctgtgttgctgcctcttgcccccatggggctgcctctgcagggagcctgagtcgtttcctccctgggcaggtttcaaaatggctaagtccagtggagaaaagaatggctcaaagggaccacaggcttgaatttgaaaaaataaaaatgctcgatgccaaagcgtagacgcacatttatttgaacgacttacactttgacctgaaacagttttttccaaattgttttccacagcggtaatctcttcaaaatgaacacatgtgaggtcttcgaatgtatgttaaaggccagtatttgtttttttttttttttttttttttgctttggaagaaccgacctcatcgtttgcatgagaacctgatattcttggtcctctgtaccttttgtaacttcctctgaatgagaggaaatatggtttccagttatgtttaatttactttaaacaaatcaaagcacagatttctacttcctgcctgtgtaatacttgactgcaggcagcttcaaagggcagaatcactgttcttgtgactgtgcctctgtcgtgttctgttataaacagttcaaagctctgcattgtacaggagcgcgcggaacagcatgtagagatctttttctctgtagtggcggcagagctgtgtgtgcccttttgctttgccttgtgctggtggtggattaagtttaggttttcatagaatatatatttatgtagagactcagagtttatttttcctgttttctccagcactgcttaactcattctctgaaatgtttatcacaaatggcaggtggggctcagaggatgtctctatctttgttccttggcttaaactggcaggttgttgtaaagggcagtgggagggaaagaaaactaaggggaaaccaaattacttatttagggcttgattttctggcaggtgaattgggcttaggaaaccccacctagattagcagctgttcctgaccggcccctcgccaaagctgcacccctgggtggtggtgggggcttcaaattagggtgtcccaagggctggattgttccagcaaaggtgttcctggattcccaaagcaagttcacttgttttaggaacagttccctgaggctctgcaggggctgctgggctgccttgtctccccaggtccatgacgccaggccaccatccatgcatcctgttgtgtgctgggacggggtgccagatgctggcatccaggaacagagagtggattgcatgaacatggctaccatgcagttggttctctgctgctggggtgcaggcacctgaaagacacggaggagctaacccagctgagaagggtgtgtgccagtcaggacctggggtgcaggacacaaacatcacaccactgggttgcacaagacttggaggaggggcccaggaggatgacatcaaggtctggagggggttgctcaacaacacacctggatgtgcagtgcaggcatggcacctgcctctgcagcagggcccaaagactcgatggggctgccatgtggcctgatgtgagttggagtgaggctgtgacccccgggtgaaagctgcagcctgcatgcatcgatcacaagcgagggctggctgtgtcctcatcccaggaagggcggggtgagggcctcaccacagtgtgggcagggcccactcacgccctgggaagtgaatcaggaggtggcagcaggcactggggctctctaatctcttgcccgtctttgtccagttattgtgagagctccaattccctgttcttatttttctgaaagtgctgataagatgggtacagaataaatcaaatgcaaagttacgtttcctggcttaggaagcaaaaacctaagtataaccttggaagtgctcctgggtactcctttctttccccaaggtgatttttccctcttaaacacattacagtaaaatacatacaacattcactactttaatcatgttttgtttgtttgtttgtttgtttgtttgagacagggtctcgctttgttgcccaggctggagtgcagtggagcaagcacagctcgccttctgggctcaagtgatcctcccaagtagctgagactacaggtgtgagccacagtacctgactgattttgaaaaaaaattgtttgtagagatagggtctggctatgttgcccaggctagtccaaacttctgacctcaaactatcctccaggctgggactcccaaagtgctggaattacacacgtgagccactgtgcctggcccactttaattttttttttttttgagatggagactctgtcacccaggctggtgtgcagtggcacaatctcgactcactgcaatctccacctcccgggttcaagtgattctcctacctcagcttccctagtagctgggactataggcatgcgccccatgcttggctgattttttttgtattttttagtaccaacaccatgttggccaggctgttcttgaacttctgacttcaagtgatccacacatctcggtctcctaaagttctggaattacaggtgtgagccaccgcacctggccccactttaaccatttttaagtgcattaaggacattcacagtgttgagcagccagcaccatcaccatctccagaacgtcgtcatcttccgaggctgaaactctgttcccattgaacaccacctccccactccccatggctgtctcaggagctggcctgagcactgctgccctcaaggtcactctagaagtggagcttcagttcggcccccacttcctgtggctctatccctgcaggtgtgcccgggatccagaggtggccccatgaggccttgtccgagcaggtctggctggacccttgctcctcttggagctgggtagggctgggtgggctgcgtagggatgttcagggcagtggtcacctgttgcccagctctgggtggagccctgtctgaagacagctgttcttttctaaagaaagaagatctgtcagacgttagtcatctgcaccactgtcacagctgacgttgattgagctcctgtgtcctgggcactgtcccaaaagccccctgcatgcagttcttgccatttagtaccttttgttttgtgtttactgaatggatacagccggaagctagctaaatttaactcacgccctcgacttgggtggaggtgaggaaggggctttctgaggcagggaattgggtgagggctttattttataggcatactttggagatagtgtgagttcagttccagaccacactgcagtaaagtgaatatcataatgaagtgggtcatatgaattttttggtttcccagcacatataaaagttatgtttacactaaactgtagtctattaaatataggatagcatcacatctaaaaaaaacaatttttatatgccttcatttaaaaatacttggccgagcgtggtggctcatgcctgtaatcccagcattttgggaggttgaggcgggaggatcatgacctcaggaattcaagaccagcctggtcaatatggtgaaaccccgtctctactaaaaatacaaaaaaaaaaaattagctgggcatggtgtcgcgcgcctgtaatcccagctactcaggaggctaaggcagaagaatctcttgaacccaggagacggaggtggtagtgagccgagatcacgccattgcactccagactggatgacagagcgagactccgtctaaaaaaaaaaaaaaaagaaagaaaaagaaaaaaaaactttactgctaaaaatactaatgatcatccaagtcttcagtgagtcagaatctttttgctggtggagggccttgcctcggtgctgatggctgctgactgatcagggtggtggttgctgaagggtagaggggctgtgacaatgtattcaaatcagacaacagtgaagtttaccacattgattgactctgcctttcacaggagatggcccccggcactggaggctgcttgataccattttacccacagtagaaggtctttcaaaattagaaatcctctcaagcctgctgtgttttttcggttatgaaatattctgaacgctttgttgtcattgcaaccatgttcacagcatctgccccaggaggacgttccgtctcaaggaaccactttctttgttcatccctaagaagcaactcctcatgtgttcaagttggatcctgagattgcagcaattcagccccttcttcgggctccacttcttttttttttttgagacggagtctcgctctgtcgcccaggctggagtgcagtggtgcaatcttggctcactgcaagctccgcctcccgggttcacgccatcctcctccctcagcctcctgagtagctgggactacaggcgcccgccatcacgcccagctaattttttgtatttttagtagagatggggtttcaccgtgttagccaggatggtctcgaactcctgacctcgtgatccacccacctcggactcccaaagtgctgggattaccagtgtgagccactgcacctggtctaggctccacttctaaatctggttctcctgctgtttcccccacatctgcagtgactttctccactgaagtcctgaaccctcaaagtcatccatgagggttggaatctacttcttccaaactcctattaatgttgatattttgacctcttcccatgaagcaaaaatgttctcttttttttgagacagggtctcactcgttgcccagtctggagtgcagtgatgtgatcgcgaggacatcaacaaccttctgggctcaggtgagccctgcctcagcctcccaattagctggaactataggcatgcaccaccaaacctggctagtttttttttttgtttgttttgttttttttttttataaacagagtctccatatgttgccctggctggtctcaaactcctggactcaagtgattcttctgcctcagcctcccaaattgttggaattaacaggtgtaagtcaccacaacttgctgcttttcatggcatctagactggtgaatcttttccaaaagattttcaatgtacttcgcccgaatccatcagaggaatcaccatctatggcaactatagccttatgaaatgtatttcttgaataataagacttgaaattgaaattactcttcagtccatgggctgcggaatggatgttgtgttagcaggcatgcacacagctttcatctccttgtccatctccatcacagctcctggatgactaggtgcagtaatattttgaaaggattctttttttttttctgagcagcatttctcaacagtgggcttaaaatattcagtaagccctgctgtaaacaaatgtgctgtcatctaggttttcttgttccatttctagagcgcaggcagagaaaatttggcatgattcttaaggccctaggatttctggaatggcgaataaacattggcttcaacataaagtcaccagctgcattagcccctaacagagccagcctttcctttgaaactttgaagccagtcattgacttctcctctctagctaggaaagtcctagatggcatcctcttctgatagaaggctgtttcacctacattgacgatctgttgtttagtgtggccaccttcatcagtgatcttagccagatcttctggataacttgcggcagcttctacatcagcacttgctccttcaccttgcacttttatgttatgtagatggcttccttccttaccctcatgcacaaatctctactagcttctaagttttcttctgcagcttcctcacctctctcagccttcatagaattgaagagaagtaggatcttgctctgaattaggctttgacttaaggaaatgcatggctggtttgatcttctatccagaccactaccacattctccatatcagcaataaggctgtttcactttcttatcatttgtgtcttcactggaggagcacttttaatctccttcaggaactttacctttgcattcacaatttgattatttggtgcaagaggtctagctttcagcctgtctcaacttttgacagccttcctcactaagcttaatcatttctaacttttgacttaaagtgagaaatgtgcaacccttcctttcacttgaacacttagaggccattgtagggttattaattggcctaatttcaatattgttgtgtctcagggaatagggaggcctaaggagagagagagagatggggcatggacagtcagtggagcagtcagaacacacatattatcagaagttcactgtcttatacgggcatggttccgggcccaaaacaatgacaatagtaacatcaaagatcacaggctgggtgcagtggctcacacctgtaatctcaacactttgggaggctgaagcacgtagattgcttgagcccaggagtttgagaccagcctgggaaacatggtgaaacccagtttctacaaaaaatacaaaagttatccaggcatggtggcacacgtgtgcctgtggtcccagctactcgggaggctgaggtgggaggatcgcctgagcctgggagattgaggctgcagtgaaccatgactgcagtactgcactccagcctgggtgacagagtgagaccctgtctcaaaaaaaaaaaaaaaaatcattactcatgaggcaggagaatagggtctggaagcagggaacctaaatcctcaccttttctgcactggcagatgggaaattggctgtcttcaacaaatctgactgattgccggtggagtctttgtttgcaacttggtaacttcactctggccttggaatggttgctgtccacaatcaatcagactgattgtgggcagagtctttgtttgcatagaagtataactctgtaacttcatcctagcctctgattgctttttgcaaccaatcagatgtttgcacaggagtgtgacctttgtaacattacttcagcctctggttggctgctttctgcaaccaatcagaatgattgtgggctatcacttcatttacatgagatgagcatgaagtggccaatgggaaacttcttgggggtatttgaacccaagaagattctgtatctgggccctgagccactgcttgggcccgctcccacactgtggcgtgttctttcattttcaataaacacctgctttcattcttttgttgcttcattctttctttgctttgctgggtgttttgtccaattctttgttcaaaacaccaagaacctggacaacttgcagtcacgaccctctaccggcgacagtcaccgatcaccatgatggatacctaataaggaaaaagtatgacatattatgagaattaccaatgtgacacagagagccagaggtcacatactgttggaaaaatggcaccaagagacttgctagacacaggcttgccacaagccttcaatttgtagaaaacacaatatctataaaatgcaataaagcaaactacaataaaatacaggtgtgcctgtattctattttgccccaacctccacaacaaccatgaggtgcaaagatatttcacccccattttgtagaccagaaaacaagcagagagaggctaactgtaagggtgtgtttttagatcccaatgccaggaagggtcagagtgcaggttctgccacatttgacatcatgcggtccagggggccactgcacctgatgcccgtgtcatcagggctgggatttggtctccaatgcacctgtgtgatcaaggcccaggatgtgtgccggggggtggctttccttcctgggggaatgtgactggcccataccatttctggtttaactttctagtgaatcgattttcatgtctttagagtttaaactgtgcaggcagcctcagggagagccaagagttccgtggacagtcttgaagcttgatgggctcttctgagtgacagcgtgagcgccaggcacgagtccagactgtgatatgggctttgaccctctgacctcattgcctctctgtttatccgctttgcttcctctgcagctgatgtcattgtggttcacatttcgcagtaggatgatccctggggagtgggtagtgagggacacttgttggggagggcctgtctggacctagggacagagctgggatcatcagctgtgacctgttggccagatcccagcaccgctctaccccatggctcaggagcttactatgtttgttacattgctaaatggtcagaaagaaggaagaagaaagaaggagaagaggaggaggattattattcacgattggcctaaggggctcacacctgtaatctcagcactttggaaggctgaggcggtggactgcttgaggccaactcaatccccgtctctacaaaaaattaaaaaattagctgggagtggtggcatgagcctgtactcctagctactcagaaggatcgcttgagcccaggagttggaggctgcagtgagttatgatcgtaaaaaataaaaagatttcatgacatgtgaaaacgatctgaaattctaattcactgtccataaatgagctttactggaacacagtggtgcccattccttttgctttgtgtgggctgttttgctcccacggcaaggttgagtagctgggacagaggccatgtggcctggagagcctaacatatttaccaactggcccttcccacaagacgcttgccaagcccaggccctgcgttccctcccttcctgcgatgacaaagtcaggttggtagtcacatttcatggggttggcacaaaccgttggtgcttaatcggagtggaagaggctgtgctgggggccaactgcacaactgcacgggttccagagagaaggcagcggcccacatgccatcaactgtcccacacctgtggctgccagggcctgcctccgagggacgcccccctccgcccgccgtgtgttcattaagagggccggggtctgtggtggccccacaggcagcgggcctctgtcctgtgctcaggtggtgctctttgaagggtggcagggccgggggctcctcttgtgctgccagagctggtcccagagacccacctgcccagggccagcccgtgggatggcagccccgtgcgtgacagtggccttcgcatagtaccatctgctcccagtggggcggttctagacttgctctgggaagcagcctttccagataacaggagacaccccagccagtcggtggggaagcaggcctggggtcggccacggggactctggagggtctcttcaggccacggctggtgtttcctgaggaagtggggccgacacagaagggccagggccgcgtggttgagaagtaaggatgaggatgatgggggctgctaagatccctggccccatcactgtgcagcttttctactcacttgtggtaacaaacgcccaacatgacatttatcatcataaccatttttaagcacccagttcgataacctaagtatatcctaagtatatccttagtataacctaagtatatccgcgttgttgtgcatccagtctccaaaatccttttcatcctgcaaaactgaaacactgtacccactaaaccacaactctcctttctcccttcttttcagcccctccccagcttaccattctgctttctgtctgtgaatttggctattctagagaactcatgtcagtggactcactccgcatttgtctttctgtgactgacttattttactttgcataatatccgcaaggtccatccacgtggcggtgtgtgtccgagttccctgcctctccaggctgagtgatgctgccttctgcggatgtgtcatcttttctttatccattcatctcctcatgggcactcaggttccctctatctcttcagcatgggtgggcatttgccccaatcctgctttcgcttcttttggatctacacctggaaatggtgtgctggatcagaggctcttcttacttttaacttttgaggagcagccacactgatttccatagcagttgcaccatctcacattcccaccatcggcacacgagggtcccaccgtctgcacatgagggtcccaccgtcttcattcacatcctcaccagcatgtgtgtgtgtgtgtttttttaatagcagtcatcctagtgggtgtgatccgttttgttttaagtaaggcataattttcatacaacaaaatgcacagatcttgtttcccataacaggagttttggctgatgaactttcatgaaatctacatcccacccagggataggacatttccggtgctctgggaagctccctctcacctttccctgtcatccctctccacccggcaccgggttgctgtcacaccggaagagcagtgcctgcccctgcccttggtgccgatgcacccacagtaaagacagaaaggtttgcgtgggcccaagcctgcctccccattaggcagccctgctcagggctgctcctcgcacccggggaggaggtgcctgtgcctccaggagcagggagagggctgggtttgcaggtgccctgcatccagctccagcctctccccagcccgctgtgtttgcttttggagggctgagcacaggatgtgcccgtcctctgcctgatgacagtggagtgatgtcaggccaggtgcttcccggagggaggcagggcgtgcagcctgctgcctggcaggggagggggtgggcaaggttcccaaagagagagctgagctacgggccgactatgcatcagcgatgtttacaacagcttcccgccctcaccagtttcgaagtttgcgtttccattctgagagcctcattttcagccccacttgctgctaaagggcagtttatcttcagaatcaacattcggatagaatcgcgcaccctctaacctgggagcagaatgtgctcggctttgacaactatacagtttttatgagcagcaggttcctgaaaagcttgtgttcccaaggccaggctggtgccacgggaaggcctgtcccaggctgagctccgtctctcctcccgtggatttactcagtaacgttgcaggagtctgagccccgacagtgtcgtgggttcattcaaccttcagcaaatcattattcctgtcagacgcttgggatacagagttgagcaggctgggaaccagggggcagactcaggggatgacagcatcacacataaatactcatatccacctaagtgtgcattcaggctgggtggtcagggggtcccttagaggaagccacaccagaagggtggatgggatttagccaatgagaagagctgaggtggtgagtctcaggggagctcggatgcagcctctgtggggaggtgtgtgaagggccatgccctaaacagcgtccagggcagtggggtggccagcccctgactgagggggttaatgggggtggtgataagccccagaaccagaattgcttttcaggcctcagtggctcagattccagaggctttggtgtctttggcagaaagagactgaagtttctatttcagttctctcagtgaaaaccagcatttctcacccaggctttcatgctttggctgagttctaggctccttttctcccaagacatggagcagattccaggctggtggccgtctctgtgtggtgcctgagctgcgtggcatcgatggctgtgagctttgtccccactggctcacgagctcacagggccacactgccttctccacaccgtaccccacagcatcgcggtgccagtgcctcctggcctccagaggtggctattggctgcctcatgccttcctcagagatctggtttttaaagtaaagtgagggtcagtaaatggagggagacagaagcaaagaaaaatgggttggacacagaaaacaaactggctgtcagagctctgatctgaatctcaggcatcctttcctttcttttaaaaatatgtgattgtggtcaaacatacagaacataaaaggtctacccatttttaagtgcgtagttcagtggtgttaaatccattctcactgtgctgcagccactccctagaactcttcatcttggcctggtgcggtggctcacgcctgtaatcctaacactttgggaagctgaggcgggcggatcacccgaggtcgggagttcgaaaccagcctgaccaacatgatgaaaccctgtctctactaaaaatacaaaaattagctaggcgtggtggcacatgtctgtaatcccaggtactcaggaggctaagacagaagaaccacttgaacccaggaggtgaagtttgcagtgagctgagattgtgtcattgtactctggcctgggcaacagagtgaaactctgtcccaaaaaaagaaaaaaagaaaagaactcttcatcttgcgtgaatattaagcattttttgaaaaacaaaaggaggccaggcattgtggctcatacctatagtcccagcacctgtattatcaaggcccagggtgtgtgcctgggtgtggcttccttcctgggaaggatcacttcagtccagaagttcgggaccagcctgagcaacatgacaaaaccccgtctctacagagaaatgcaaaaattagccaggcatagtggcacatgcttgtagtcccagccactctggaggctgaggcaggagaattgcttaagccagggaggtggaggttgcagtgagctgagattgcaccactgcactccagcctgggcaaaaaagtgagaccctgtctcaaaaaataaataaaaaataaaaaaggaaaggaaagaaaataaacagagcaaggttctcttcaaaatttagctgcagccaggtgtcgtggctcatgcctgtaattccagcactttgagaggccgaggtaggaggatcacttgagcccaggagtttgagaccagcctgggcaacatagtgagaccttgtgtctactaaaaaaagaaaaaatttaaaaaaccaggcatggtggcatgtgcctgcagtcttagctgctcagggagctgagacgggaggatcccttgaggccagttcgaggctgcagtgagctgcgattgttgcactgcactccagcctgggtgacagagcaagaactttctcaaaaaaaaaaaaaaaaaaaaaaaggccgggtgcggtggttcccagcactttgggaggccgaggagggtggatcacttgaggtcaggagttggaggtcccccctggccaacatggtgaaaccccgtctctattaaaaaatacaaaaattagccagttgtggtggcatatgcctgtaatcccagctactcaagggctgaggcaggagaaccgcttgaacctgggaggctgaggttgcagtcagccgagactgctccactgtactccagcctgggcaacagagactctatctcaaaaaaaaaaaaggctcagctgccaggagccagcatttttcctcttcccatcattccctttctgcagccaactcctgcccctcctcatgtgcattgtgggggctgtcacagccctgtggcttctgtggggcgggggcacagcggtgactgctgcccagggtagagcttgtgcagaggctggctccccatgacctgcctgctcctgagtaagtcactgactcccctgcagctcttagcaagccaagggacagggctgcttgctctgcagattggtgaggtgagggacaaccccccagcctagcggctctagtgctgtgggaaggtgcagtctgcggcagaagggcccagggacttggcctgttaagggccacgccaggctgtttccttcatgtctcacctgcagcaccaccacacctgccgctggtggagcccctcccccctcacacccccacttctgctccttagcaggtcttagttctcattttgcatcacagtgggccatgtggttttccacaaaacaagagggagaaaggcaataatacagtggctttcgatttgtttcgatttgtagtagtaaagtctttctttaaataaaatcttccctggtaattgtgtcatggaagaaataagcaaagcatctctagttgaggcagccagggtgcctccccgtgctggggcgcccccactcccaaagcccgtatgcccagaggcccctccactgacccaggaatttgtaaaccctcgccttggtgttcagcaggaagctcacacaggggcagcaacaagccccaccgccaccccaatccccccactacgcctacattgaggctgccctcgaggtgagttcatgcatacagaagtccaaatttagaccacacgttgggggtgatactgcctgaggtatgaagataggatttgtctgataggcagatgtaaaggctggaaattacctgcatgctaaaaagcaaaacagagattccaggttcccatggtggagggaagcacagaatctagtaagacaaacctcccagaaactcaccgcagcaaccaagttgaagagaggaacaaccacaggcctcgaacttcaggagcccatggtcagggagaaacagaagattcgggtgcagcagggcatggctcccaacagaggcgtgaggatgatgtgaggctggggtcttaggggctccagctcccctgctaatttggagagatgggggctagaggcagccctaggaaaggatgggaaggagctgcagccccccagcactacgagtctcggtcctgggtggctggcgagccctggggcactgtgctgagggcaccgtgggcctacactcgtggccaagcggcggcccctgggtggcctacactcgtggccaagcggcggcccctgggtgctcctctctgctgccatcaccgccttctgcctggctttgtgtcctctcccatcccctgctgggctccatcctgcacaggcccttcccatgacccactccccttcaacccatgtctgctgctgaccccccagcctagcctggggtcccatccttcctgctggcccttctgcctcccgttgcctcctcagcccaccctggtttcccaggcctgcgaccggcttcggactcagcgaggctcacattcaggagtaaagctgaggacctgcactcagagctgggcattttaaaaatcatctttatgaagttgatcagaccaaaaaaaaaaaaaaaaaagacaaagaacttgcttgcatcacaaacatcctagtgtccaccatccctcttcagaaatgagatctgacaatgcactccacatcccagaggcccccgaggtgagagtggcagtcctgaatttggtgttaacattctttgcgtgggtttgtacttctaatgcctaggcttattcctccaagtgatacagatcacactctgcagtagcacaggagatatagagacctattacctttatgcatggatagatgtagctatctctccatctgtctccctgcccatgtatgtgtgcatttctctatccattcatatatgtatgtatgtatctattccggtacatatacacctgtctatccatctagccatgtatatatgtatgtgcctagccatccatccatgtacatatgtacctatctatccacctatccattcatgtatgtacctattcatccccctgtctattcatatgtgtgtgtacctatctatctacctatccatccatgtatgtatgtacctatctatccacctatccatttatgtatgtatgtacctatctatccacctatctattcatatgtgtatgtacctatccatccacctgtctattcgtgtgtgtatgtacctatccatccacctgtctattcgtgtatgtacctatccatccacctgtctattcgtgtgtgtatgtacctatccatccacctgtctattcgtgtatgtacctatccatccacctgtctattcgtgtaagattgtacctatccatccacctgtctattcgtgtatgtatgtacctatccatccacctgtctattcgtgtatgtatgtacctatccatccacctgtctattcgtgtatgtatgtatctatccatccacctgtctattcgtgtatgtatgtacctatctatccatccacctgtctattcgtgtatgcacgtacctatccatctgtcgttctctttcttctgcagctcctttcctcacctgcagtgtgtgagcctgccacgctaactgtgacatgtgtcactccagttcattcatgaatagttgcagggttgctggggcacacagagtaccaggggaatgccagtcctggctgggccacagtgtccatcctactgatggagtgtcagcggggtgggggtgggactccagttttctgcaagtctagcacggctactgaacagtctcatgcaggcgcaaggggttccagggcaggtactgagacacgggcttgccaggtcccacggcatggctgtccttggcctcctgacaccgccacagctctggccaaggctgctctgcatcaccccccaccacaggcgtgggagccgtctttctggtttctgtggtccgttctgtttccagtttgtgaattaccagttcctgttttcccccttttcaatgggttcttggccttttcttaattaagttattagattctatgaatattctggattctaatgcttagttggctctatcctctgcaaagcttttctcccagtctgtggcttaaagtcttttcactcctttattttgtcttttaatatatagaacgtttacagtggaatgtagactaatccagcaatctgctctgtgctttcagtgttttaatcaagaagttatatttcataccaaagtcataaagccttctgcattttcttctgaaagttgtaaggttttatcttgaggtctttggagtaaggtgtgacatagagattcagttctgttttctttttccacatggacatgaatcgagtcccttctccctcctacaggctgtaatgccacgtggccatctgttacgtggccacagtttcttgagtctggtcctagactcttctccgtcctgggactgctcatctgtcctgagccggcacagcctttgggtatttcagctttgcgatccatctttatgccccacgttgcccttcagaacacatctgactgttctcggctcttggctttcccatcacatgttttagaatcagcctgtaatcccaacactttgagaggccaagactggaggatcacttgaagacgagttcaagaccaccctgggcaacaaactgagacacggtctacaaaaaaagtttttttaattgttaaatgtggggccgggcgcagtggctcacgcctgtaatcccagcagtttgggaggccgaggtgggtagatcacctgaggtcaggagttcaagaccagcctggccaacacggtgaaaccccgtctctactaaacatacaaaaatgagtcgggcatgatggcgggcgcctgtagtcccagctacttgggagtctgaggcaggagaatcgcttgaacccgggaggcagaggttgcagtgagccaagattgcgccactgcactccagcctgggtgacagagtgagactccatctcaaaataaataaataaataaaataaatagttaaatgtgctgctgtggtaaagcacacttaaaaaaactgcattttacagtcatttgtgttagtgagcctgaatgctactgaattctgaatattgctcttggctcccacacccttcagagctttctctctgacactcactgggtcatggtctgccacgtgactccacctgcctctctctttccggctcccacagccttcagctttctgacattttacatggtccaggggcatccttgccatgttgaaaatagaggtgatggcaggcatgatacagcagaaatgttaatacaagaagagagaacttattagctatgcatgactctgtgctccaacacttgaacatttcattaaaatagacaatttcctaggaaaaattaaatgttcaaaacctggatctaaaaaaaaagtaacctttctattgcctctttgggtgttttttataattattttcagcatattggccccttcttaaggggaaatcatgtagagtagaaaaaaaaaaagcgcaccgggtcactgtgatgcctccccagttaccacccgagtggctccagcagacactctggagaccagagcccggccaccagagcaccacaggggaccgccacctgtcagggctttaaaaatactgcgttcctttctctgtttccttctactctactttcactctttttgaaagtgaggttggcctttttacccaaaaactctcaaagtcctcccacacactgtcgttggccactgtcatttagcaggagggagtgtgtccagcctgggaagtgagcgactgcaactctgtgtttgcctaaacacagtttcttgttgccgatgcctgctctcttctcttatttactctgtgtaccgagggaggtgggcaggcggtgtgagtaacctctctgctcccgtcgaagctgcagccccgtccttgtgtgtgttcacagacaacattggcagtaccatcatgatgactggtgccacgtcctgaacaatcggcccacggctgtcgggatgcacctgggcttgggaactggtgtcttggatgtgggacacttcccagatcacaacgagagcttccatggagagggagtccttcccagactgtcagatggccacctcagagacagtagtctttgggatgaatacttttgtcaattttgtctgcattcctgaaggaataggacatcattttgaagaacttgggagtattattttacctaaagctaggaaaacaggaaggaactgtgttgttattttagatactgttcagatacgatatgagcattgaaatgaatagggtcatcagtcgctgtggtttgattttattgtggtaaaaacacatattatacaatttaccatcttgattttttttttgagacagagtctcactctgtcactcaggctggagtgcagtggcacgatcccagctcactgcaacctctgcctcctgggttcaagtgattctcctgcctcagccttccaagcagatgagattacagacatgcgccactatgcccagctaatttcattttttcttattttttgtagagacagtgtctcactatgttgcccagcgtggtctcgaactcctgacctcaagggatccttccacctcagcctcccaaagtgctggcaaagtgctgggattacagacatgagccaccactcccaggctttcacttatttttagattggattatttgattttgttgttgttgagttttaaaagtttttgttgttgttgtgtgttgttgttttttttttcttgagacagagttttgctctgtcacccatgaaggaaataatgtatacagtggtctatttccaagacaaagtgcattgaattggcttaggtcagcaaactacagaagaaacaggatataccaggcccctgcttggatagccaatgactgcttgtcggccttccccttccctctcttcttgccacgccccgcacccccaccctccccacccttagttgccttcacctgaaccaaagaaattcagtctaagacgaaagcttactagtcttcaaaatagctcgctttgtctgttcttttcagcctgcccagctacttaggtcacaagtcaaaaacttggagaacccctgagctaactaggattgcaatgcattgtgggctgcaacaaaatgcagcaagataactgtaaaaaaaaaaaaaaaaaaacacctacaggccctacctaacaatcagaacaatcagtaggcgatgtccgggaaggttgtagccccatagtactcactttatgaggaactgggggagggacctgcacactaggggatacattgcctattgaaactgtgctggctgtgcctgcctatcaggcaagatcgtcattaaaagtctcactttggctgttctctgggtctctgagtccattctttgggtttggatgagtgagtttgtttctcacatccaggctggagtactgtggcgcgatctcaactcactgcaatctctgcctcccgggttcaagcgtttctccagcttcaggctccctggtagctgggattacaggcgcgcaccaccacgctcagctaatttttgtatttttggtagaaatgggttttcaccatgttggccaggctgttctcgaactcctgacctcaggtgatccaccctcttcggccttccaaagtgctgggattacaggcgtgagccaccgtgcccagccaagagttctttctatgttgtggctgttgatcctcgtcagatgtatgatttgccaatattttttctcattctgtcagttgccattactctgttgactgagtcctctgatgagcagaagtgttaaggtttgatgtagtccctgcggtctggcttttgttaaaaacgtgttggcagggggagggagggggtcagaaccctgcaggaggttctattacttctggtgatgcattgctgagctggggcgttctgtgatcaaatttcactggcttttcttgatttctttccagcctgaaactcaggtgtggagtttatgaaagttcttcatgcaaaagtgagtgttgtccctgagattgctaaagccgatgccctcacctgaaggaaagggagcatagcgtaggaacgctggttcctggatgtctttctttggggcctatgtcatggggggcagagtcaggttctaatgttgattctaaaagagaagaccccatttgagagagtaagcattgctggtttgctaaaagtaagaaaagtttctactcgttagagagactgtctcctgcggttgcctggccgccctttgcacagcccgcgaagggcacgtgggaatcctgctccattccaggtcccgggccagtagctccaggccgcgccagggtcggtgcagagcggcatttcccgcccccacacaccttgacaggccaggtaacaagagaggcctttctagaaagtccctggaaaaggctctttcctcccaaaccggcagattatgctttgtatgtctgttgtggcaagaaccttttcttgttttctttctcaaagtgacaaattgatggcagggcagataaatcgtattttctttccttctttctttctttctttctttctttctctctctctttctttttttttcttggtgacagggcagataaatcatattttctttctttctctttcttttttatttttctttttgagatggagtctcgctctgtcacccaggctggagtgcagtggcacgatcctggctcactgcatcctccgcctcctgggttcaagcgattctcctgcctcagcctcctgagtagctgggattacaggcatgcaccaccacgcccagctaatttttgtatttttagtagagatggggtttcaccatgttgggcaggatggtcttgaactcctgacctcaggtgatccacccacctcagcctcccaaagtgctgggattacaggcatgagccaccatgcccagcctttttttcttttcttttcttaatagacagggtctcactttcagtcactcaggctggggtgcagagtttcaatcctagctcactgcagctttgacctcctaggctcagctgatcctcctgcctcagcctcccaaagtgctgggatgacaggtgtgagccattgttcccagctaaatagtgctttttcttctctctaacattgaaatatagaaagtatgaaaaagccactcatggtcaagcggcatgtccctgcagagctgtcagccacactgcctcccagaatccaggttgggggtttccgatgctgtctgttccatgtgacctcacagcctcctgaaccaactgatggccccaaatgtttatccccattccagatggcacctggtggtacctgaaagtgacctctgggctgcgaggtgcgtggtaatgtccctgtggcccatctctagatcgtgaagagggtgatgtgaatcatagcacactccaggacatcacagggccccagcacaattgtgtatgctgtgactccgtcacccaactacttcgagtcttcaaagacattgaattgccattgttctaatacttatttgcctttggttcccactccttcctccccgtggtgggaagaaagttggggaatgtgcacccagaagatgtcggggctggatcaagccccttttcagtcactgtcattcatagttgagatgtgaactctgcaaaggcagtgagtacagaacattcttgtttccagtgcaaatccactgtgaccaggaagctgtgcctaggtctctgactccagccacccatacctcctctccctgtacccagagccctggatgaaagcatgagtctgggatgctgggaagagggcagacaatgacagctcccaggcgctgtggaccaggcaggctctgtgttgggctttcctggcagacgatgctgtagttagttaatcctctcgaggacatgtgagatgagggtatcattaccttagagatggaggatctgagcctccagcagataagcagctgccccgctgcagagaactgaaaatgaagctaagcttgttggcttttccccaccagctgcctcccacttcctccacctgctctgtctctgcagaaaacatcaagaatgcaaatccagccccttggccagctcatttgcacacacactcacctcaggggtctctgggggtgtcttggatgcagacctccatccctcacaccctcacacctgtccgtccaagggtcaggccatgctggagtgcctgggctggcctgatggagatgctgcaccagctgagtcatggcgggaaaacagccgggaatcacccaatatctattccttccttcctttccattttcttttacaacagcaaaatgatgccaagatttttctgtgcttcccctgttataggctgatttatggcctccctcccaagttcctatgttgaactcctaaccacccagtcccaaccccatatggctgtatttggatagatctttttctttctttcttttttgagacggagtcttgctctgttgaccaggctggagtgcagtggtgcaatcttagctcactgcaacctctgccacctgggttcaagagattcttgtgcctcagcctcctaagtagctgggactacaggtgcgcaccaccacgcctggctaattttttgtatttttagtagagacgggatttcaccaggctggtcttgaactcctgacctcaagtgatctacctgcctcggcctcccaaagtgttgggattacaggcctgagccactgcacctggctgagagagggtctttaaacaggtaattcattcaaaatgaggtcatgagggtgggccctactcttgtatgactggtgtcctataagaaaaggagactagggcctagcaaggtggctcccaacagtttgggaggccaaagcaggaggattgctcaagcccagatgttcgagaccagcctgagcaacatggtgagacccccatctctacaaaaaattttaaaaattagccaggcatggtgaggtgcacccgtagtcccagctacttgggagcctgggaggctgaggcaagaggatcgcttgagcactaggaatgtggggcttcggtgagccatgattgtgccactgcactccaatctgggcaacacagcaagatcctgtctctaaaactaaataaagaaagaaaaaggagaggagattaggacacaggtatgcccagagggatgaccctctgagggcatggcgagaagacggccatcgacaagcccgggagaaggtccccggaagacataaccctgcccacgccttgatcccagacttccggcccgcagaatataagacaataaaggtctgcggtgaggccaccagccagtggcactttgtgatggcagccccgggaggccaaaacagctgcctgttccccacgtccctctcccagcagaagcgcatgggctgctcttgagccccagctgcagtccatcactgtcagtgctaatgcgaagctcccctaagactgacttgacaatattggcgagtgggcttgacccaccagcctgcatccggtgccggtgaatgggcacttacgttccttattgaaacgctacttgtggccctctgcttcccggagctcctggcaacagcccaactttatgttccaaataggaaaaggctgcttgatttaaagactcggacttcattaggcgttaccttgatttatggaaaaataatactgaatggttgcataacaatggcccactgctcacctacgtgtggcctggggttaataaaaccggcacatttgtctctcccacgatgacgtcaacgtgtaccagcccttctcttccacatgggaaacgtgttatgttgttccaattgtacattcacttggtgaagggttgtgttaagtgattccaaaaattgactgtgtatattttctctagggaagttattgtatattattttagctgggaacatctctcgcacacaattactaatcagaagtgaaaatcaggatttgtccccggcccacctggcggatctgatgcagcgccagggcagcccgtgaagacgggcgctcttcctccgtgactctgggccaggcagaaggagccttggagaggctgcaggaggaagcccggcttgaggccattcctgttttgtcttgctggaattcaaagatatttgttaatcctttccccccacttgagttgagaaggcctggaatgaggtttcacaagctgtgccctgtagagctcctggggaaactggctcgaaagaatgacttctcgagagggaaactaatatttgcttattttccccccactaacttcccaagggaaggctaatctttagaaacacagaaactttggaggccaataaaattgagagcaagagaagcgagattgtttcattgttgccaccatgaaggagagtttgtttttactggatttctttttcccttcaggaaggctctggtaagagtcctgatagattattctcgcacccctggttctggctttccccccattgtttcaattgcccttttaatcaccacgatctcagtcaaggtcaaggctgctgtttcatgtacccgtgccccgcctgccctcctctgccgcggattcccatggggatgtgtgtggctgcatgaccacccttccgtgtcaccaatcacaccgagcagccctgaagccagcgtggggtgtcggcagggtggtggcactcggcatttcccagcctcttcttggatgcctggggtcctctctgcagggtttggtgaggccctgctggggtgagagcccttggcagccccaactgtgtctgatcacaggcgaagcatttatgaggcagctgggtcccataacagaaacagggaaaccagaggcagaagtgacattacgaagtggcttacggcgctgctaagtcagggttggggtagcaaagcgtcatatagggaactgaaatgcttttcagcgcacaatagcagtgaactggatgggaatcttcgggccgagagaagtccaggcagaggcgttaaaaagtttaggcaaggaaaaggagtgaagggctggacctggtggggtggggtcccattcccaggagagtcggccctgccccagcagcttccagctggagccttcaaggacctggagggggcaggaccaacccctccaccctccctgcccttcaccctcaagttcacctgcagggctgtcttcttgcttactaaggcctgggagagtttaattccaaagcagaggatgatgactggagaaacggatgcctggttgagtcacttctgggggctcagcattggaatccctctgtaacctcccagaagcagaagtggtggcgtccaaggctgcccaggcccctccagtgatgaggagcccagaccctacaacacgcctttgccccctgcacacccttcctgctgacagccccatcccatgctcctccccatctgacccgtgtgtgtgtgtgtgtgtgtgtgtgtgtgtgtgtgtgtgtgtgtgcgccccccacccccgcagacctcccgagacagctctggcagccccacctgccaggggtcaagtgcaattcctctggaagtagcatctttcacatggaaacgttcctttattttcagtagttatggtcgtcagcgagccctcttaaaggagtcaggtgtcctgcttttgttaaaatgacgttgtctcctaactcttagagaagaggaaaaatgtctctgcccagctggcatgctggggcacagaccactgaagccaaggctttggactcgggggttctggaggctggaggaagggagaaggggatgcagcgcagcgtgttgtgtgtgcatagtgctccagggactccagaggagaaaggagtccctggggaagagacatgggtctgcctcttatcctaagtgctttctggtgctccagggagaagtgtttcttgtctgagatgtggcagacatttagaatcattgctcagaactgtctcatcttaaaccttttaaccagaaagtacagaaccattgctccaggggaaatacaagcttgtgagagcttctgtttgcaacatttcattcactaatccatacataaccttgttgtgtgtctgtttctgttgaaagacactttaatatatattattgcttctttaatgtattcaccaccagcaacaccataactcttgcctgaacgcagctcatctaacacacatattttccgcatacagttcattgcagccttttttttttttgagatggagtctcgctttgttgccaagctggagtgtagtggcgggttcaagcggttctcctgcctcagcctcccgagcagctgggatgacaggtgcctgccaccacgcccggctaatttttgtatttttaggagagacagggtttcaccatgtcggccaggatggtctcaaactcttaacctcatgatccacccgcctcagcctcccaaagtgctgggattacaggcgtaagccaccacactcggccttttttttttttttttaagagatggggatcttgttctgtcactcaggttggagggcagtggcatgatcacaggtcactgcagccttgacctcctgggctcaagtgattgcccacctcagcctcccaagtagctgggaccacaggcacacgccaccacatccggctcatcacagcctgtttgtgcttaggaacactagacagccctcaaggtctttacctataaagtagagatgtcagagatgtcagaggcacttgaaccagagcaactccatcttgaataggggctaggtaaaataaggctgagacttactgggctgcattctcagacagtctttttttttttttttttttttttttttgagacggagtctcactcggtttcccaggctggggtgtaatggcgtgatcttggctcactgcaactaccaccacccaggttcaagcaattctcctaccttagcctcctgagtagctgggactacaggtgtgcatgaccacgcctggctaagttttgtatttttagtagagacggggtttcgccatgttggccaggctggtctcgaactcctggcctcaggtaatccacccaccgtggcctccgaaagtactgggattacaggtgtgagccaccactcctggcccctccggttaggcattctaagtcacaggatgagataggaggttgctgcaagatacaggtcataaagaccttgcagattaaaacaggttgcagtaaagaagcaggctaaaaagccatcaaaaccaagatggtgatgagaatgacctctggtcattctcactgctacactctcaaactgtcaacaatttgacaatttacaaatgccatggcaatgtcaggaagttactctgtatggtctaaaaaagggaggcatgaataacccaccccttgtttagcatataatcaagaagaaaccataaaaataagcaaccgaggccgggcatggtggctcacgtctgtaatcccaccactttgggaggccgaggcgggcggatcacaaggtcaggagatcaagaccatcctggccaacatggtgaaacccaactctactaaaatgcagaaaaaattagttgggtatggtggtgcgcacctgtagtcccagctactccggaggctgaggtaggggaattgcttgaacccgggaggtggaggttgcagtgagctgagatcgtgccactgcactccagcctggcaacagagcgagactccgtctcaaattaaaaaaaaacaaaaaacaaaaaaaaaagcaaccagcatccctcagggctgctctgaccatggagcagccattctttattccttcactttcttaataaacttgctttcactttactctatggactcgcccctaattctttcttcctcgagatccaagaaccctctcttgggatctgaattgggaccactttccgggaacagagacagcagggcaatggccagaggccacatgagacagtcagtagtgtatggaggcggcagcaggtgcccagaggcatccccggcccacccccagagcctggcctgacatccaggcctcgcaggcttcaggccaggaccctaccagcaaccccccacccccgagcaccccaggtgtgtatgggtgggtggggcctcccgtcagcccacccaggggcctgtcacacccctgctgcacacagcctctgcactctggactgcatgctggagcccgtgggcatcagagccacgggctgggcttggcaggatgcacctcccagcaacggtgtgctcacttctcctgtcctcccctggctctgatgacactgtgaggcagcaaaccagggtcctgaagggacctctaaagatacagtgtgtgcagggaccctgcccagggtgagagcagctggagctcttgccgtgatcatctcaggctgcccaggtgaaggtgtttccccaacagccctggccacagaggaggccaggcctcttccctgcccaccagtctcatggccctccagccttccctcccgccacctgggccagggccaagagtcttggagggaggttcttattgctaccaggtgacccctgctcctggctggcatggagcaaagtcacccttgctatcaatttaacacagatgaaagatcatgcttgttcccattcccaccacctggacatcctcctctcctggaccctacagcctgcgtggggggtgcatttgcaggaatggaccttgcctccctggagtacctcttggcttacagccccatcctccctggggtctgctatcctactgacctgagcgtgcacactgctgatctcctgacccactgtttaggaaaatcactcctttccaagcctcctgtttccttgcaaatgctctagagcaggggtccccaacccctggggtcacaggaatgggccacacagtaggaggtaaggcgcaggcaagcaaatgaagcttcatctgtaacagctgctcactgcttgaattaccccctgaactctgcctcccatcagatcagcagcggcattatattcccataggagcacaaaccctattgtgaactgtgcatgtgggggatccaggctgtgtgctcacgagaatcgaatgcctgctgatctgtcactgtctcccatcgcccccagatgggaccatctagttgcaggaaaacaagcccagggctcccactgatgctacattatggtgaattgtatagttatttcattatatattacaatgtaataacgatgtcataatgagaatataataataacagaagtaaagtgcacaataaaaatgtaatgcacttgaatcatcacaaaaccaccactccaccctcggtctgtggaaaaattgtgttccacaaaaccagtccctggtgccaaaaggctggggaccgctgctctaaggcatagcagtctttaaccttttggggcaccatggagacttgcatagcctgatgagctctgtggaccccttagaactgctgatgtgtgtcgcttacattcagagatggagaaaatgctaaaccttagtgaaaataaagatgctttttctcccatccaagctcctgagtgccctgaatgccacccatggggaccttggggaagccctaggacagggatgtaggtacagattgacagtccagagctgccatcagggagaagcatttgcaaagcacaggctctgcaaatggggtctacttcctccatcccccaagcctgtcttctgcttcactttgccaagactctgccttgccccagtgttggagcaggatgccagatggcaagatgggcttatgggctgggtcttctgtttggtcgcggcagagcccatggcagctgtaggaactttgacggggaaggggcaggggcgggagcaaacctgtagcgtgaaagtatgtgaacgctctgtcatggagggcaccccaggccgtgtccaggccagcttcaccctgtctctgggagaaggaagcctggtcagagctgaggaggctccagggcaccaggccttgtccctcttgcgcctgggcgtgatgctccccaatggcgtgcgccagtcctgggaccattgctgccggccgtgtgtcttcttccagggtgcagaatcccttgtcaagctgggtggtttgatgccagcccctgggcctcgaagctcccttcctgatggagtgctgccatttggaaggggtaactttcgtggtcatttttttaaatcatggtaaaatatacataactacataacataaaatttaccattcttccttttcttttcttttcttttcagacggagtctcgctctttcgcccaggcgggactgcagtggcgttctctcggctcactgcaagctccgcctcccgtgttcacgccattctcctgcgtcagcctcccgagcaggggactataggcgcccgccaccgcgcctggctaattttttgtatttttagtagagacggggtttcattgtgttagccaaaatggtcttgatctcctgacctattgatccgcccgcctcggcctcccaaagtgctgggattacaggcgtgagccaccgcacccggccaaaatttaccattctttctaaccattttaaagtgtacagttctgtggtattaagtacattaacactgttgtacaaccagcaccactgcccatttccagaaggtcttcatcttcctaaactgtaattctgtgcccattaaactccccatgtcttcttctcccagcccctggcaaccacgattctactttctgtctctgggaatttgacgactcttataattggagtcatgcaacttttgtgtctggttggttttactcagcagaatgtcgtttcatccatattgtggcctgtgtcagaagttccttcctgtcaaaggcggaatgatactccatggcaggtttacaccacattttgtttttccactcatccgtggagagacactgggtgggtccctccttttggctgttgagaatgatgctgctgtgaatgaagtggttagaagggggctttcagacgtgtgaaaggtgtctttgggaattttaatttcagctcccacaaatgagtaaaatttgtctttctgtgcctggcttatttcacttaacataatgatctccaattccatccatgctgttgcaaatgataggatctcactcttttttcatggcttcgtagtactccacggtgtatttgtaccacattggcttcacccattcgtctgttgatgttcgacaccttattattatcgactgtagtcaccctgctgtgtaatagatctcttttcttttttattgatatttcagaattgtgcatattttggggcacatatgatattttgatacatgtatataatctataatgttctaatcagggtcgttgggttattcatctcctcaaacatttgttttttctttgtgttgggaacattccaattctagttattttgaaatatacagtccgggcgtggtggctcatgcctgtaatcccagcactttgggagactgagacaggtggatcacctgagatcaggagttcgagaccagcttagccaacatggtgaaaccccgtctctactaaaaaatacaaaaaattagctgggcgcagtggcaggcacctgtaatcccagctactcaggaggctaaggcaggagaatctcttgaacctgggagacggaggttgcagtgagctgagattgtgccactgcactccagcctgggcaacagagtgagactccgtctcaaaacaaaacaaaacaaccccagaaatacacaattcattatcgttaactataactttcctactctactttcaaatactagaacttattccttctacctatattttttaatccctggtgatctcttttcttatgggagcagtgtgcgccctgatggtgtaaggtggaaacccgccccttgttggaaccaggattgaatatcaccgcacaggagctgaaggttcccacccggcaacgtccccccttggctgtgaagcagagagcccagggctgctcgtttccagtagtcctcctggcagagcaccgctgaggagggtggtgaggggaggagaagatgcattctgcagggagaagcatcatagtgggggccggggactctcctgcgtctcctaattgcccgactgtcatgtgaccgatcagtgcactccgagcattacacagagcagtcatccaaagagaggcagcgcctcacagcccttggctggagaggagaatggaggctggaggctccagaaatttgggatgggaggagaaaaggaaacagaggtgccccttcccctgtcttattgcagggaatcagtaaaacgactactggagttcactggcttctctgaatctttgtagaatttctcctgcacctctgatcccatccagctgcagacacagtgcctgttcagcagggtgtgtgtgcagaccacggactcacagacggggaccctggggaccccaggttctctcccctcactgaggacaagagaggggcccccaccccatgttaatgatgcggggcctgcagggaccttaagttgcattagcatggcatggaacaagagagaaaattcagaacctccagcttgtgatatgcaacaaccaaaaatgtggctgagtgtggccgccttgcaaaggcctgggccctctttaatgggtgcttgctgccctctagtggagagatgaggacggggggtgggcgagcttgctcaaggacactcactggggaagggcggtttgcagacaggtgtcgtgttttggtatatatgtgtgtatgtgtgttatgtgttaggtgctgcgagcatatgaaatgaattacaacgttgttatgggctgtactgtgttcccccaaattcacttgttgaagtcctaagccctgctcccttagaatgtggctgtatttggagacagggtctgtaaagacctgaatgaattaaaatgaggtcattagtgtgggccctgatcccgtatgacgggtcttcttcttcttcttctttttttctataacatctaaagtgagatttatttgtgttaagctttcagaacatttcagaacatttgctgcgactcaggtaaaaataggtaagtattcacagaatatgttaagtctagagttcagaaagttatttcaactaaaataggtcaatcctcacatctgaaatcacttagacattactgatgtatttggaagtgtttctgtatagatattttaggctgacggtgctcagtgctttagggggtcaggtaaacccagttctcgtttgttcagcggtgcctcatttccactacataaagcttgttctccagttccaccaccaatgcctactttacgtgatgttgcactgtgttggtgccatgtaaggtgattatattatgaaaggcctctagaccaccttgttcaaatgtaacagctggtttcagtaattccaggagcaagggaactgtctccaacaattctcaggttgataaatttgattttccaagtattctccacaaaagggcagcaggtgagcccaaaactttgttcaaaaatgcccaagcaagtgttccctcgatgtcccagcagttcccagcagttccaaccatcaccagcccatgaagagaagaagtacatttctacattgggctgagaaaaagaaattcttcttttactagtgacggcaaacggagactcatgatttctgtcccatggtagtccatcccttttttttttttttttttgacggagtctcgctctgttgcccaggctggagtgcagtggcatgatctcggctcactgcaagctccacctcccgggttcacgccattctcctgccttagccttcccagtaggggactataggtgcccaccaccacgcccggctaattgtttgtatttttagtagagacggtgtttcattgcgttagccaagatggtgttgatctcctgacctcgtgatccgcccgcctcggcctcccaaagtgctgggattacaggcgtgagtcaccgcgcctgacctcttttttttttttttttgagacagagtcttgcttggttgtccaggctggagtgcagtggcgtgatctcggggcactgcagcctctgcctcccaggttcaagtgattccctgactcagccttccgagtagttgggaccacaggcatgtgccaccacacctggctaatttttgtatttttagcagagatggggtttcaccatgttggccaggctggtctcaaactcctgacctcaagtgatccacccacctcagcctcccaaagtgctggtgtgagccaccacacccagccagtctatcacgttttgttctgacttgttgtaatagaatctaagctgagtctatcacgttttgttctgacttgttgtaatagaatctaagctggacatcatgctgtggttcccattcatcttgaggtggtcccaggaaagaattgtgagaattaagaagtccaaagacccggtgacagaattctcccaggcaatgaaaatcaaccttttcagctttttaatcttttgcctgctgtcgaaagagctggatgtcctctgtctttgtaactggctctggtgtttccttcaattttggctgtgattgcttttatacgctaaataagactgtgttttttagtaactggaggtataacaaccaccccctggtgttgccaagtacttaaatgtgaccagaaaggtggacgtttttacgcctcagaagttctgcccttggactgtccactaacattacatgaaaggtgctccaaatcctcaaatcagcaagtgctgcccatgacatggataatcccggaagctgcgccattgtcactgccaccacctcctggcgggcccagctgcctaagcctgtgtagtggttccgaaacgggaaaggttcctttgtccgccttgcagggtgtgggatgggggtgtggctcgtttcttctgtgtcctgcttctcccaccgctagagggggcatacagatgggcaggttgtggggctcaggccccacagcagggtctagagatgaatgtttacagctgaagccccagttggcgtatgctactgtttgttcttttagttttgctgtctataggcggcttgtgttaaccagctcaattagaccctctacttgtcgcgtggacagagggctttctgtatcccgggttcttgccttggtgtaccggaagagtcggatcacacatgagcttggataatgggtgcaaggttttattgagtggaagtagctctcagcagatgggggaaccagaagacagatggttttcccctggagtggggcagctgggtggcccagacactcttccgactcccggccaaactccacgtcattccgcgatcagtggcatgcctgtgcctgtgggcgcattcctctcgccagccggccacttgtggattcctccgccagtgtgctcctctccacgtccagccgctcctgtctctgccttgctagggtctgggtttttataggcgcccgatggggcgtggcagcaagagcggtcttggaaaatgtaaggcaggaaatgcctgtcctcacttaggtccgtgggggtggagccttagtaagaaacggtctttgctttgggaggccaaagtgggaggatcacttgagcccaggagtttgagactagcctggacaacacaataagatcctgtttctaccaaaaaaattaaccaggtgtggtgttgtgtacctgtagtcacagctactgagaaggctgaggtagcagggtcagaaaacgccctcctatacccgcacttcccttggcacttcccttacccccttccgtatcatttaaagggaccatgcttctcccttctcagcatttccgtatcagtttcagagcagtggatctgccatggtggcagggattccccaggattctgcctaagcggggtctgagactaactgggttctaggccccgaaccccctccactcccaggctccagtgacctggggtcagcatgaggcttgggaaggagtggctgtgttccatggcacaggtctgcccttacattggtggtctttgggctgcaccaggcaattggtgacggtgctgcacagggccatgaatctcctcattgtccagtagcccaagtaggttacgacagccctccgtctctggagagctgagtcctgacatctcgacccccgggacagagggagaggacgatggcaataatgttgcccctgtggcccaccaggcccgcaccttggcaacacacaccagaagtcatggcaagtgttcttataagaagaagagattaggcctataatcccagtgctttgggaggccaaaatgggaggatcgcttgagcccaggagtttgagactagcctgaacagcagagtgagatcccatttctaccaaaaaaaagttagccaggtgtggtcttgtatatctgtagtcacagctactcagaaggctgaggtagcagggtcacttgagcccaggaattcaagaccagcctgggcaatatagcaagaccctgtctctacaaaaaattcaaaaattagcctgggactatgcctgtagtcccagctacttgggaggcagaggtgggaggatcatttgagccctgcagtgagctacgatcatgcgactgtgctgcagcctggatgacagagcaaaaccctgtctcaaagaaggagaagaagagattaggacccagacaggcacagaggaaaaggaaagaccccgtgagaacgcagggagagaacggccattgacaagccagggagagaggcctgagaaggaccaacccttccagcctccaggactgcaaggagtaggtgtctgttgtttaaggcgcccagcctgtggtacttcatcatggcagccccagcagactaacacacacggattctgtccttcaggagccagtatttgtagataaatcatgactgaatggcagtggtgagcaaaacttaatggcccttgccagcttccaaacgcccagcgctttctgcgtgcaccctcaggcagtggcatcgggcacacaaccattcctagctcaggaaaccaaggggaagaggttccgctgcaggcccgggagcccagccgatcccaaagactaaagacctaagccccgggcttcccagaggaggggcacagccttttgaaagcaagaggaacttctgacaaggtgagcagggtgaggaagttattgattttgattttgatttcccctgaattctctataaaaatagagggggcaaccagaacccaggtagtgaaaccaaagcccatgttggaatttacaacctagtgaggggaggccgcggcctcggggcgaatccatgaggggttggcatgtgtggtggggggagtgctgggggagactgggggacatggcagcgggatggggaggggaagataacaccaagcagaggagaacgaggacgcaaggagaaggagacggcggactgcagaacgagcagaggagcgcaacagatgctggcaggccgcagagaaggggcaccctcctttaagtttaaggacgcaaatttcaaggtcaaatcctatgcaaaggattataagtgtattacaagaaaaaagaaaataggacgaataatgtaaaatggatgaaaactatgccctaatcatcatgtccaaacaaactttaaacaagaaactgatacaagatacgtgacaacatacatacatttctctgaacttaaaacttttaaaaaattgaaaatgaatggcaagaaattaggaaagggttgtaatgaatatttaaatatcatttcagagatgaatattaaacaagaaagacaggagcaaatagacaagggcctaagagaaatagaagttgaaaagaaagaaaatctttgagcataaagaaaagagaaacacgtaaaatctcactacagaccagcgctaacagaagaacatttcaacttgatgacagggaacactagttttgaatcttgattaagcaaaaagtttctcctgtgcacacaagaggaattccaaggataacaagtgttgatgaggtagtgggaaattagaacccttgtgcactgttcatgggaatgcaaaatggtacagtatggggattcctcaaaaaattaaaaatagggccaggcaaggtggctcacacctgtaatcctaccactttgggaggctgaggcgggaggatcacttgaggccaggagttcaagaccagcctgggtaatatagtgagaccctgtctctacaaaagaaaaaaaaaaaattagccagacaaggtgatatgcacctgtggtcctggctactcaggaggctgaggcaacaggatcacttgagccaaggggttcaattttgcagtgagccatgattgtaccactgcactccagcctgggtgacagcaagaccctgtttcaaaaaaataaataaactagaatgaccacgtgatccagcagttttatttgtcagtatgccggaaaggtttgaaaagcaaggtctccaggaggtacctgcacacccatgttcacagcagcatcattcacaacagccaacctaacctgggttgcttggggaggagcaacctaagtgtcagtcaacagaagaacagatgaacgaagtgtggtttatacatacactggaaaatttagcctcaaaaaggaaaggaattctgatacatgccctaatattgatgaaccttgaggtcattatgctcagtgaaataagccaatcacacaaaagacaaataccgtatgattccatttatatgaggtgccatgtgtggtcaaacccatagagacagaaagcagaacggtggttgccaggggctggggaggtggggatggagcattggcatctaatgggacagtctcggttttacacaatgacaaagctctggaggtgggtgtggtgagagccgaatgtgaatgcacttattgcccctgaactgcatgcttagaaatggtcagagtggtgaatgttatgcgtattctaccacaatttaaataacttaattaaaaacaattccattcttctcattagtagacctatcttatgaaaaactgtactcttattatatttgaatttcatcaataaaaattgtgtggaaatgtgtttgtctcttgtgatgtaagtacctacatggtatctccagttttggctcttctcctgcaaggtctgaaacatattctctctggccccgcacagaaaacagttccggacccttcctctagaacagggttcggcatgcggcagatgcccaggaaagagtgaaggaccaagcttcctcccttcttcaccggatccctctggcagcttcgggtccagtgaaagagaacccaggccagtcccttctccgtgagcctcgccccacaaacaccggcctcccttgcctcatctctcgcatcttaaatctctttcacctacgaaccgactcaagcatcagccttagaaggatgccctgggccccgttcctctgtccatgcacatccaggctctaccccgggagttcaaggccaccttcagttcctatatcctgtccctgctctctgtgacctctgaccccacagccccaggtctctaagcgtcctcccacctgagccgctgctcaggccagccccgagcagccctctgtgggtcctgattcccaaagagcatgatcccaggtctttctgggtccctcccaccttgccctacttcatgcttccgtgcctagccacacccctgcacaacctgtgatctggcctcaggaaatctgtttctcatgtctgctgtataggcttggctgcccatggcagcaggaagaacctcgcctcccttgctcacacagcaaaggcgtttaggcctcatattggggaagcccagggtgggaggcccctgactctttggacccatgacgacatcaagagtatcttcgtatctgtgctctgccatcctcagctggctttcctcagctgccatttcagtcttcacaccagatgtgatggtgtcccaggaagaagaggccatctcttcccatggctctcttcgtcaatagagagtacattctagaagccccgtggtaggcttccctatggcttgcacaggactgaatcacagaactgtgtcctcagcagtcactggcaggggacaggggtcacccgaactgggtggaggcccgaacctgacacccctgagctgtgctaagcagagggctcctgaacagaattgagattgaggccacagggccaggctgactccctcctgccccacgtgctctccggtgagaccctgcttggtctgcaaagccgagctcgatgccctccctacctcttctctcctaggcctcatccacggccttgtcttgggccagacagccatgtgccatgtctgtcctcccatgcagcatctgcaccgtgggggtggggggggagattctctgccacgttcagcacctcaaaggcagggggtgcatttcactcagctctgcatcctgtgcaccctcagccatgccggcagagcatgtgtggggaagggcccgagggaccccagggaaggaagagcactgtgtctgcatccagaagaaagttctgaaaaaaatgggaacctctgtgactacaatgaacttgtaacaaaagcaatgactttgctcttccaggaggcacaaaaggagccccaggcagtgcgcaggacccccaggcagtggtcaggagccctgggcagtgaggaggagccccaggcagtggtcaggagcccagggcagtgaggaggagccccaggcagtggtcagggggcctgggaagcagccaagagccctgggcagtggacaggaagcccaggcagtggccaggggccccaggcagtgagtaggagccatgggcagtggccaggagctgcagcgtgccagtgttcgctctggcactcagtcagggacatctggaccagcatcctgcatgggctgggtctcaggctccttgctccatgaattagcagaatctcaggcacctgctcttgaatatgggaaggtgacatagcacttctagtaggtcttttcctaacctcttccctttgcagttattctttttcaacctaagcatgccaggtgatgaccttgtgattctcctaacatacaaatggcaggcatggaatagttcctacccagggtgctgtgctggccaaggcttttccagcttggagcagacctcatgctcagccaggagactgcccacggccttggtgagttccagagtctcctctccctgcaggggtgtcttcaggagcccacaacccagcaagtccctcttcagtgaaatgtgcgggaggaggcactgcaaggccccaggcctccaggaagccggaaggtgctgatggggtgcaaggcagggcagggctgggggagggggggcgcaaggttcacagaggcagtgagtggagttctgttaacagggaaatgaattaaaatatgtggtgcgtggactttgggtctcgaggcccagaaagctgaggcaaggtggcctgagtcaaatggacagggattgtctgcccaggagctggttcagccgacatcagagatcatctgtctgcacaatggcctgctagtaaagattttcaagttgttcacacgtgttacccttgagggtttagaaacattccctgggcactcccagggtgctcagacagatgctgtggactggtggccagtgagcactaatcatgacttttatttttctttttgagacaagggtctcactttgtcacacaggctggagtgcagtggcacgatcacagctcactgcagcctcaaactcccgggctcaagtaattctcctgacttagcctccagagtagctgggactacaggtgcataccaccacgcccaactaattttctatttttagtagagatgaggtctcactttgttgcccaggctggtctcgaactcctgacctcaagtaatcctcccatctcggccttgaaaagtgcttgaattataggcatgagccactgcacctggcataatcatgctgtttatatgttatgatgttttgatatcttgggaggccaggctggctgggaagagactgtccctcccagagacagctaaatcctacagatgataaacaacttgcctgggagcctgtttattcacatgcagaccaacccatcccaagtccatactcccaaccaccccctctatctaactcttacaaccaagccattatttcctgggccctgaatcccacagggccaggcagcaggcactagggatggccctataccctggccagccagccttattcagaccagctggtcctgagctgttcacctgccccaccttgaaaggctctggtctcagctttccctgtctcctctctgcttcctgacccaacctgggtcacccactgtggccttgtgggtggggtgagtgtgcccctcctctccagaaatacgaataatgaagtctttcagtggcgctggccactctctgtgggtgctgacacctctgtaagttaaactcccataggcacgatggagacgccttgtgactcagctcctcagtgccaacacgggctgccccgtcggccacagcgcggccaaagagcccagagagcgttagtatctgtagccaggcccctgttgccaccccagctctcccgtaacctcacatgcatggcgctgctctacttcacctcagaaaaaggacacacatttacgttccattttttacttcaaataattgtttagattgtggtaaaatacatataacacaacattggccatttgaaccaattgggtggcactaagcacatccacagattgtgccaccatctccaccatccgtctccaggacttttcaaccgtctccaccatctggctccaggactcttcagcttcccaccacaaactatccccatgaagcactcattccccatccccattctcctccccttgcccctggcgcctaccattctatttctgtctccgtggatttgactcctctagggtacctcatgtaagtggaaccatgcagtatttgtatttgtctttctgtgactggtttatttcactgagcataatgacctcagagttcatccctgttgtaacatgtgtcacaattccttctttcttttttttttttttttttttttttttggcaaggtctcactctgtcactcaagctggagtgcaatggtaggatcatggctcactgcagcttcaaactcctgggctcaagagctcctcctgcctcagtcttcccagtagctgggactataggcatgcaccaccatgcgtggctagcattttatttttgttgagagagggtctcgctaggttgcaattctcccatcttagcctccaaagtgctgggataacaggtgtgagccactgcacccgacccagaatttcctccttttgacggctgagtgatgttccattgtccgcacacacacattttgtttatcctttcatccattgatggacacttgtgttgcctccacctactcgtagcaccctggctgttatgagtagtgagtgcactatctcttgtgtgcagttgtctcatggagaccttgctttcctgcctgtggcgttagtgcaggtggcaggcaggtcggtgggcaagcaggtgtgccctgtggatgacgagaagctttttctgcttaaagccctgcatggatcaaaagttggaaaatatatttgatttttacaatttgttcaaaattaatcaagcaaacactgattttcatgtattttctgagatctctgctataaaacagaaaaccaccaccctctttccagggaagcatcttcttcctggctccctccttcccttcgggccatggcggcatcctcggatcctccctagcccattcatatcacacggcttttcctcctctgcatctcgataccactggctcctttgggaggttcctctgagccacccatgcgcggggtgggttgtcatgaaaagtcaccagttccacctccagccagaagtcccacaaaagcgaagggcactgaagacaaaaccacccttcccttctctaaaggaggaggggcggtgcttcagagggtgtcccccaaacccgttctttagagcagggtccccaacccctgggctgcggagtggtacaggtctgtggcctgttaggaacgggcctcagagcaggaggtgtgcggtgggcgagtttaccgccgagctccgccccctgtcggatcagctgggcattccatgctcatgggaggcaaactctatcgtgaactgcgcatgtgagggatccaggtggtgcgctccttccgggaatctaatgtctgatgatcagaggtggaacaatttcaccccgaaactatcccccacccaaccccatcggtggaaaaattgtcttccacgaaaccggtccctggtgccaagaaggttggggactgctactttagagcatgtcctcggagtggaggtacctgctctccacgcagtacagcatctggctgtgtggtggctgcagtccagtgggtctgagaggggtggagggggaaggtggagaaggagaggagggaggaggggagggagggaaaggtgagaggggaagacgaagggaaggagaagaggtgggggagggggcaggggggcagcattggccaggtaagggcgtgtccactgtgaggcaccgtgggattcctgggcgaggactgtgagacactggtgagcgtgtgtgcagggctctttcgggcttcctctgtttttaatgacatcagagtgcgtgccatgcatggggctgtcctggtgttggcactgaccgcttggagcccagctgctgccccctttctcaggccacagatgcgcccaagagcagggtttgtccaggcccgcctgggcccgctccacgccatcctgcagtgcccacgcagcagcggtgccaggtcttccttcagcacccatgcgtggttacctgtggccgatgtggcaggcgtgtagggtgtgactgcagaactgcatggaccaagcaccgtctgcctcctaagggagcaatgggaccgaggaagtgggccccatgttggccttgaccagctgtgcccacctccttttgggaacagatgtgccaagaacaaccaggctaaggaaacgtggctcgcacaccgggagccctggggaaagactacaacgatccttttaataatactttttactgactgtagtcatagtgtaataatttcagaaaattcagaaaccatagaaaagtatacagaagaaaattaaaattacctggtgcccccaccaagccacagtgatcattgttcaagcattaacaaattttcctggattttggtaaacagatataagtgcatattttaagtggaaatattctatatttagttttgatccttgttttcatccctttaaaaggatttttcatattattcaatcatctcctaaaatacagttaccagtaactgccttcattccattagatgctgaaatggatttaactgttctctggtggttagtcatatattcttgtttctttcttctttcctggtatacataatattgggaacatcttggaacaagatggctgtactcaattattgaaattcctaaacgataaatgactggaggagaatcctggatcaaggaggggctcctggaagtgctctgggccctgctggaggcacaggccttggccacaggccaccacacataccctttggaaagagactttgccattgtgatcggccaaaaatgaaacctcactttattttattgtgagacagtgtctcattatgtcacccaggctggactgcaggctcactgcagcctcgacctcctgggctcaagagatcctcccacctcagcctccctagtagctgggaccacaggtgggcgccaccatgccaggctaattttgtattttttgtagagatggcatttagccatgttggccaggctggtctcaaactcctaggctcaagggattcgctcatcttggcctcccaaagtgctgggattacaggtgtgagccaccacgcccagcctttttcacttaattttgaagcttggagataagttttatataggcccatatacggctgcctgaaacctcactttaaaactaggtatatttgtttgctgcctgctgaggctgagtgctcattgcctgttgcttggctatttgtaattgtcttttgtgaattgctttttcttatcatttgcccatttttgtactggaatgtttacctcttcctggctgatgtgcaaaagctcttcaattcccttgtcatatgccttccagcatgttatcatggcctttgcacgtctatgggtttccatggccagacctctggcttcttatcttcacggcatcacctttgctcctatgcttagacgatgcttgcacatttgagggaaagggagcattttcctgtttttcccctgtatttggtttattacatttggctcttaaatccggtggttcccagttaggggtatgcatcagatttcccaggagggcttttctaaccataagtgcctgcctcagtccatccagatcttcccatcagcccccagggtggggcgggtgatggcgggtgggggtacagccttgttttggaaaaagtgccatagatggtgcagatgcaagcctctgattatgggcttcttccttctgccacatgtgtgatgtaagataaggatgctatttttattggcttatattttaagaatagctgattgcacaagtatatttattgtgcaaacgtgccttctttccccactcagtgacattatatctaaaccaaattctcaattataacacgggaacgtttccctttagcctgcgaagatccagtgtctcggttatggtgtttctggttccccggccacttggaagacacctggagctctgtgatcttggtggggacctcaatgtcagccgggacctcaatgtcagcagaccctgtgtccccagtgtggctgggctttgctagacctgtggagcaatagctagtcaggcttgtggccccaatccagccagcatcacacactgtccagcctccctctgacatcagcataggtctaatgtcagcataggccctctgccgcagggctgtgcccaaggacactctcctgctctgggtcctaagggagggaggatctcaggagaggcctctcctcatccctggcagatctctcaaaatggcctgcagccgggattccagacacctgagctggtgtgagcccactccccaccgctggctctcaggctggagtggggccaggatgtcactgagctcctcagagtttgcagaccatttgcccctcagctggacccctggcccaccagggacttgagcaaagctgttccatcaacgcaggggaggtgagaccacatctaatcaggggtctgatgtacacacagcaccatcaccatctcagaaaggttcatcacccaagcacaaagaagctggacttggacatctgacagcaaagcatgacccattttatgtgaggcaacgagtctgaaagcaggtaaccgggacacccaaaagctgaaagcacagaggggttggcgaggagtgcctggacctctccctccccaggggtgtcttcctgtcagagttatgcatgctcttgccagagagggcaagcttgacagccaactgccgcttgatcagcctgcccctcctgcctcacctcctgtgcctcagcacgtggccatgtccccatgcccccccaaatctcgcaccctctccaccgcacagagctctgtcttaggtccccaagggccacatgggcagcctgagtccttcccttacttcgcaggtttttccacagcactggtgttgattgctccctcccttagggagctctctcctgactctaagctctcctctcgagctcctgcctctcgctccctggctgggcacctccctttcctctctgagatgatgccctccagggctctttctctgcagctttcctcactcaaagtgttttcattctttcccagggccttgcctctctttttatatgggggccccagaacttgtttggagccacagacctgttgtccccgctgctctaggggcctctgcaattgggcacacatagatctttcccagtttactcccaccccagtgagcggtcccacagcctcctgctgccttcacaggcatctgggggcacacacattcatgtggtctgacggcatctcaccttgcacttcttcctgctcgcctgttggaggtgccacagaggcccctccatgccacgacctgtggctgagtaggtttccacacttacttttttttttttttacagttttattcaggtattatttacttaactccaaatacacccattgtattgagtttcagtaaatttatagagtcgtgccactatcccctcagtccagttttagaacatttctatcacccaaaaaacattttcttgtgcctgtttgcaatccccactctctgccccacccctggctcaaagcagaccccgatctgctttctacctgtagatctgccccttcaggatcttgaacatttacttttcgccagttcactgcaagaggttgagtctcagcaagagtaaggaatggctccggagaggtgacaccagctaaatggtggactaaggacctttggaaattctctcctccagaaacttgacgacaatgctggcaaaaaatcatcataatcagctgtttcaaaactctggaaattaaccaaaggcccacagaaatttagggaatgcttattcaagaaaaacagctgactttcaataagaacaatggacttcgtggtgttttgtgggtttttttttgagacaggttattgctctgtcccccaggctggagtacagcggtgccataatagctcgccgtaacctggaactcctgggatcaagggatcctcccaccttaacctcccaaaatgctgggactgcaggtgtgaaccaccacgacttgctaatttttaaatttattatagagatggggtctcactatgttgcccagactggtctagatctcctgacctccagcaatcctcctgcttcagcctcccaaaatgttgggattacaggtatgagccacggtgcctgttctgtgtgatgttttagcctgcactgttctcatcattctcccctcagctccacaatggtcttggagactaacagcccaccactatggtgaaaatgaacatatggcagctgctgaaaggtgtagagagggttggagccccatttccacagaattgtcattatttgaccgctctggtggttccataaagaccccacccacaagactttctttatttgatcggacttgggggatgcccagtataaagagctgtttccctaggagcatttgttgaaaacaaccagaggtgattgttgtatatcatggttgcctgaggtggtgtataacagttggagcaaataacaagctaacccagatatttaaaaggaaaagctgggaaacaagatgtctataggggctttgacaagctctgacacattcttgggcatctagaaggccatgtgcagggatgagtgtatactcaggagaacctcacctctcacctctggctaaccttgaagctctgcagaagtgggaagtaaaaagtaaggtggagttgccaactgcttggctgagggtcaaaagtgtgcccctacccatacacagagcccctcggcaaaggctaagagacatactggttccaggtatctaaaaatatttgtgtccagtcatttagctgcccattaagctaactgaatagagacttcagtagccacacacaaaaacaaatacaaattttacataattagcccaggaaagtcactgaacaaacaaacagcaacaaaccctggggaggagggggtgcaggaatctgatttccagagttgccatgttatattattttaaaatatcagtttttaacaacaaaaattatgagacactgtccatgagaaagcccagattgttggattcaccgtacaaacaccttaaatgaactgcttttaaatatgttcaagaactaaaaggaactatgtctaaagaactaacaaaaaatatgagaatgatgtcttaccaaatagagaatattaataaagagaataatttttttttttttgagatggagtctcactctgttgcccaggctggagtgcagtggtgtgatcttggctcacttctgcttcccgggttttcaagcgattctcctgcctcagcctcctgagtagctgggattacaggcatgtgccaccatgtccagctaatttttgtatttttagtagaggtggggtttcaccatgttggccagactggtctcaaactcctggcctcaagtgatctgcccacctcagtctcccaaagtgctggggttataggtgtgagccaccatgcccagccataaattatttaaaaaacaaaaagacattctggagtgaaatgtatgataactaaaataaaaaattcaccagagaggctcaacagcagatttatggccaggcgtggtggctcatgcctgtaatccaaacactttgggaggccaaggtggatggatcacctgaggtcaggagtttgagaccagcttggctaacatggtgaaaccctgtttctactaaaaatacaaaaaaattagccaggcatggtggtgcatgcctgtaatcccagctacatgggaggctgaagcaggagaatcacttgaacccgagagttcaagagggcagtgagccgtgatcacgccattgcactccagcttgggcaacaaaagcaaaactctgtctcaaacaaacaatcaaaacagcagatttatgtgggtagaaaaaagaatcattacacttaaagaggtcagttggggttatctaaggaatagaaagaaaataattgagtctgaaaaacagaaagaacaggatgaagaaaaatgaacagagttccagagacctgtggtacaacaaccaagcataccaataaatgcataataggagtgccagaaggaaaggagaggagaaagggataaaacaatatctgaagaaataatggctgaaatttttgataaaaaacatatatgtatagttcaagaagctcaagaaactccaagtggagtaaactgaaagacatctacacctagatgcatcataatcaaactgtcaaaaaccaaagacaaagcgagcatctcagagcagcaggacagaagccacttgtcacacacaatagagcctcaataagattgacagctgatttctcaccagaaactatggaggccagaaggaagtgacatattcaaagtgctaaaggaaaacaacaaaacaaaacaaagcaaagcaaaacaaaacaaaacactgttaaccatcaatctatatcagccaaaactatcctgcaaaaatgaaggagaaattaggacattcccagataaacaaaaacagagtttctcattagcagagcagccctacaacaaatggtatcggccgggtgtctttcaccctgaaataaaaggacattaggtaatatttcaactccaaataaagaaataaagaactccaagaaggataaccacataggtaaatatcaaaaacagtataaatgtatttttatttgtaactatttttttctatctaatttaaatgacaactgcataagcaatcattataagtttaggttgatgggcacacactgtagaaagatgtaatttgtgctactgtggcatgagtggaggacacagctatacacgcacacacacattcatatatatataagaaatttctatttctcagtcatttgaagataattaaatggtacacatttaacacaaaagaagaagtggagaaatgaacaaaacagacataaggcatgtacaaaacacataacaaaatggcagataatcctattcaagagtaattacattaagtgtaaatgtttaaagagcccaattaaaaggcagaaattggcagaatgaatataaaaacaagatccagttatatgttctcccaagaaatataccttagatttaaagacacaagtatgttgaaagtaaaagaatggaaaatgatataccatgcaaacagtacccaaaaaggagctggagtggctatactaatattagacaaaataggttttagcacaaaaaatgttactagaaacaaagtgggaagttttgtaataataaagggtatattcatcaagaagatataacaatgataaacatatatgcacttagcaacaaagtcccaggatacatgaagcaaaaaatgacagattaaagagagaaataaagaattcaacaataatagtcatagagttcaagaggtcattctcagaagttcaacaagaaaatagaagagttggccaggtgtggtggctcacacctgtaatcccagcactttgggaggctgaggcgggtggatcacgaggtcaggagattgagaccatcctggctaacacggtgaagccccatctctactaaaaatacgaaagaaaatcagccaggcgtggtggcaggcgcctgtagtcccagctactcaggaggctgaggcaggagaatggcgtgaacccaggaggcggagcttgcagtgagctgagactgtgccactgcacttcagcctgggcaacagagtgagactccatctcaaaaaaaaaccaacaaaaaacaaacaacaacaacaacaacaaaagaaaatagaagagttgaacaatattataagccaactataactaacagacatctgtagaacactccacccactagcagaatatacattcttttcaattgcacatgaaacatcttcaggatagaccatatattaggccataaaatgagtctcaataaatttaaaaggactgaaatcatacaaattgtcttctcaaatcacaatggaataaaattagaaatcaatagcggaaggaaatttgggaaattcacaaatatgtggaaattcaacaacacagtaaccaatgggtaaaacaagaaatcgtaagggaaattaggaaatactttgagattaaagaagaataagacacagcctaccaaaacttatgggatgcactaaaatagtgcttagagagaaatttaaagctataagcacctatattagtaaacaaggaaaattcaatttaataatataaactttcaccttcagaaactagaaaaggaagagcaaaccaaaaataatgcaagtggaaggaagtaaaaaatacagattacagtggaaataaattttaaaagagaaaagaaaataataatcaataaaaccaaaagttgacttttcaaaaaagatcaacaaagttgacagccttttgctatactgactaagaaaaaaagtcagactcaaattactaaaattaggaatgaaaaagaaaacatcaccaccaacattacagaaaaatgattataagggaatactatgaacaaatgtatgctgtggcaggtggcataatgttcccctaagatgtctatgtcctaatccctggaacctatgaagatgttaccttaaatggcagatgggattttgaagatatgattaagttaaggatcttgatatgggagtcttaacttggattatctggatgagctcaagataaccacaaggattcttacagacgaaagagggaagcaagagggttagagtcaaagatttgaagatgctatgctgctggctttcaagatagagaaaagggtcacaagccaaggaatataggtgacttttagaagccagaaaaggcaaagggacagagtctatcctggagcctccaaaaggaatgcagccttgctaacaccttgaatttagctccttgaaatccattttggatatctgacctcaagaactacatgatattaaatttgtttggttctaagccactaagtgtgtggaaatttatcagtgcaatagaaaactaatacacatgccaacaagttagataaactaaataaaacagacaaatttctagaaagttagaaacttctgaaactgactcaagaagaaatagaagatctgaatagaactacaagtaaagagattgaattagtaaaaaacaaaacaaaacaaacaaaacttcccataagcaaagcctagggtgagatggtgtcactagtgaattctaccaaatgcttaaacagtatttaacaccaatactttacagactcttccaaacagtaaaaaagaagagaacatttcccaactcattccatgaatacccacaaaacaatgccagacaaaagcacacacaaaagaaagctataagccaatatcttttaagaatttaaatacaaaaatcttcaacaaaatactagcaaacaaaacccagcaacatatacaaaggattctgtactatgagtcagtagcatttatgtcaggagtgcaaagttggtccaacaatcaatcaatcaagtcaatcacattaataaaaagatgggcaaaaaaacacatgagcatattaataaatgcagaaagcatctaacaaaaatccatcaatctttcatgataaacactcaacaaactaggactgtaagggaatttctcaacctgataaaaggcatccataaaaacccccacagctaacatcataatggtggaagactgaaagctttccccctatgatcaagaacaagacaaagatgttcactcttactacctctattcggcattgtaatagaggttctaaacagggcaattagataagaaaaaccacccagattataaagaagcaaaactatttctatttgaaaatgatgtgattttgtataaagaaaatgctaagaaatccaaaacaaaagaaaacaattactaataaactagttcagcaaggttgcaggatacaagatcaatatacagaaatccattgtatttctatacagtagcaataagcaatgtaaaaataaaagtaagaagataattcgattataatagcatgaaaaaaataaaatacttgggataaatttaacccaaaaagtgagagacttgtacaaaacattgttgaaagaaattaaggaagacccaagtaaatgggaagacatcctgtgtttgtggattagaagatgtacagttggccaggcatggtggctcctgactgcaatcccagcattctgggaggccaaggtgggcggatcacttcaggtgatcctgaagtggtcaggtcaggagttcaagacctgcctgaccaacgtggcaaaaccccatctcgactaaaaatacaaaaattagccaggcatgttggtgggcgcctgtagtcccagctgcatggcagactaaggcagaaaatcgcttgaaatcaagaggcagaggttgcagtgagctgaaattgtaccactgcactccagcctaggcaacagagtgagaccgtgtctcaaaaaaaagaagaagaagaacatgtacagtagacctttgaatgatggtggcaattcggggcacaggtgaaaatccgcatataatttttgactccccagaaacttaactatgactagcctactgtttcctgaaagccttaccaataacataaaccatcaattaacacatattttgtatgttatgtgtattgtatactgtatgttacagtaaagtaagctagagaaaagaaaatgttattaagaaaatcacaaggaagataacatatgcttcctattcattaagtgaaagtggatcatcataaagatcttcatccttgctgccttcacatccaaggaggagaaggaagggtggggttagccttgctgcctcaggggtggcagaggcagaagaaaatgtgttcatatgtggacctgtgtcattcaaacctgggttgttcaaggatcaactgtaataatgcaatactccccaaattgatctacaaactcagtgccacctgacttctttgcagaaatgggcaagctgatcttaaattcatatggaaatgtaaggggtccagaataacaaaaacaatcttgaaaaacaaaataagagcaatgttgaggactcacacttgctgatcccaaaacttgctacaaagctatagtgagggagacgatgtgacactggcataaaaatagacatataggccgggcgtggtggctcacacctgtaaccctagcacttagggaggccaagatgggtggatcacctgaggtcaggagtttgagaccagcctggccaatatggtgaaacctggtctctactaaaaataaaaaaattagccagacttggtggtgtgcgcctatagtctcagctacttgggaggctgaatcacttgaacccgtgaggcagaggttgcagtgagcaaaactctgtccaaaaaaaaaaaaaagaaagaaagaaaccccatctctactaaaaatacaaaaattagccaggtgtagtggctcatgcctgtaatcccagctactcaggaggctgaggctggagaattgcttgaacccggaaggcgaagattgctgtgagccgagatcgcgccactgcactccagcctgggcaacagagtgagactctctcaaaaaaaaaaaaaaaaaaaaagacatatagatgaatggaatggaatttagagtctagaaatagaccctcatatttatggctaactgagttttgataaggatgccaaaaagacttaatgggggaaagagtattcttttcaacaattgtgctgagacaactggatatatccacatgcaaaagaatgaagttaggctccacctcataccatatacaaaaattagctcagaattgatcaaagactaagtataagaactaaaactataaaagtcttaaaagaaaatagaggtatgaatcttcacgaccttggatttggcaatggtttctaagatacgacatcaaaagcataagcaaccaaaaaaatagataaatgataaattattaaataaattatttaaaaataaaagtattcattaaatcaataaatgtaaatacttttatgcttcaaaggactctataaagaagtgaaaaagacaacacaaagaatgggagaaaatctttgcaaatcatacatatgtaagtccctgatggaacttgtaactagaatataaaaataacttttgcaactcaataataaaaagacaacacaatttaaaaatgtacaaaggagctgagtgtggtggctcaggtctgtaatcccagcactttgcgaggctgaggtgggaggatcacttgagcccaggagttcaggaccagcctgggtggcattgtgaaatcctatctctactaaaaatatatacacacacacacacaaaatagctgggtgtgatggcacacacctgtagtcccagctactcaggaggctgaggtgagagaatcacccgagcctgggaagtaggggctgcagttagccgtgatgacatccacactccagcctgggtgatgggagtgagatcctgttttaaaaaaaaaatgcacaaaggacttgaataggcatttctccaaagatatgcaaatggccaataagcacatgaaaagatgctcaatgtcatcagccatccgggaaatgcaaatcaaagccacaatgagataccccctaggatgatggctataatcaaaaagatattacaataataagtactggcaaggatatgaaaaaactggaaccctcatgcactgctgatgagaatataaaatgatgcagctgctgtggaaaacagtttggcagttcctcgaaaagttcaacattgagttatcacaagacccagcaattccactcctgggcatatacttaaaagaattaaaaatgcgtgtgggacacagtggttaacacctgtgatctcagtgctttgagaggcaggaggttgacttgagcccacgagttggaggctgcagtgagctacgatcgtgccactgcactccaacacaggtggcagagcaatatcctgtttccacatatatgtttataaacatatatacataatagtcaaaagatggccatcaactgatgagtggattaaaaaaacgtaaaagatccatacagtggaatattatttagtcataaaaaggaaaggcccaggcgctacctaaaatataccaagccccaggtttacatagggccccaggtcacactaggctctaggtagacactggactctaagtagactttaggccccaggttcacagccacacctcaggaggataccacaccccaggtagctgtaagactcaatccagacaccagtcccccggtggagaatctacgccccagctggacatcaggttccaggtaaacaccaaggcccagttgggtttactggatccattggtggacatcaggcaccaggttggcacagagcccccacatagatatctacaccacaggtggacatgaggccccaggtacatacccagtccgcaggtgactatcgggccctaggtgaacactaggtcttagatgaacttcgggacccaagtggatacccaggcccctggggaacatcaggctccaggtggacaccaggacccatgtgggcaaccaggtccagaggtacatcaggttccacataaacacccaacctccaagtggatactgagcccccaggtgtacacaccagtccctcgacaactgaaaggtcacatactctcaggccaaatgcaatagagtcatctctcccaaaaatatgtatttgggaaagcgaaaactacacttctcaatcattctcaagtcaagggactcttaatagaaggccaaatacacactgaaagaaccaaccatgaaattcccacatccaacaggagtgcaatgctgctcaactagtcccagagcaagacccaccacaggctttgcatggaggacacacagattagaagggaagaatggaaatgtgggacctgagattgcaatacaagaaaagagaaaaaggcaaccgtgcataccaagaaacccaagaaagaaagggtgacgtggagaaataactaacccaggcccagttttccaagaaacattagaacccgcactgcgaatgaagtggcaggccgaatcgagccctgtctagattttcaggtgtgggtctctcctagatgacttaaaagcctacaaattgctgaggtcaccctgactatgtccgacccaccttgcagaaattcaccactgggaaaagacacccaaaccaatgcagttccggagcttaccttggagaagcttcctgcagtccctgggtgccactggctggctctgcggctttcttggagggcccgcggcctcagcccggctccctccctcagctctggtgcgtggccgcagatgacccgagcggcctgggcttgggcttctggtgccctcgaggagccgccctgtgtgctcacacaggctcctggcggcgggcagcacagcactctcacttttggtcaccggtcctttcccgagggcagtctggcggggcacggctccagggccccgagtccagcacctccctgaaatcttcacgccacaggcaaagcagtagggcaacttacccaggctctgcctgagccaagatggcgccttcctcacagcctgtgcaggagggcgaggtcccagatgatgaggcgcgggacaagggcaactcgccacccattcttcccagaaagagggcaggtgcatgggggcacaccccctacaggtggacataaggccccagtggacaccgaggccacgggaaaacatcaggccacaaatagacactggacatcagacaccaggttgacaccaggacctgggtggacaccaggtctcaaggggcctccagtccctgcacagacatcaggccccaaatggacaaatcaggtcacagtttggcacataggcaggccccaggtggacaccaggccacaggtacataacaggccccaggccaaaaccaggtcccagaaggacatcagacatcttagtgtatgtcaggtcccaggttgacatataggccccagtggaacaccaggccccacttgccagtttccaagtggatatccagaccccaggtaaatatcagcgtcaaggtgaacaggaggccccaggtggacaacaggcctcagctagatgcctaggcccctggtgaactccagccccctgatgaacattaggccccaggtggacaccctggccccacgggaacatctagttccaggtggacatcagacccaaggtaaatacccatccccaggtaaacgccagaccccaggcagattacaggtcccagaaaaacacccaggtcccatgaagaaatcagaccctaggtgaactctggtctgcagggggacatgaggctgggtatccacctgggacctggtgttcatggggtgggggccgatgtccaccttgggcctgttgttcatctgtggcctggtattcacctgggccctgagagtcaacctggtgcctgatagccacctggggcctacatagccacctgggggcctggtggtcacttgaagcctggtgtcctcctggggcctgttaccaacatgcggtgtaggtatccaccaggggcctgatgtccacctgaggtctggggttcacctggagccttggtgtcaccctggggactaatgtccacctggagcgtggtatccatctaaagcctgtggtctgcctggggcattattatgtcccttgaagactaagtatccaactagggcctgattttcacatgaggcctgggtatctgcccgaagccttggtatcctccttgggcctgaagtccatctgtgacattctgtccagctagggcctgggtgtgaacctggtgcctgatgtacgcctcaagtccagcgtgcacccacctgggacgtgatggccacctgaggccatatatccacatggagccagggtgtccacttggggcctaatgttcaccaggaacataagtatccacctggggcctcatgtcttcctggggcctgggtgtcaatgtggggcgtgggcatccacctgggggctgatgtccacttggagcctggtgtctacctggaaccaatttttcaactgggaacctgatgtccacctggtgcctgatgtccatttggaaactggagtccacctgggaactggcatacacctaagacatagtgttgagccggtgtttgatgtccaatgttcaccaggctccaggtggacaccgggcctcaggttgacacccagactccaggtggacaccaggccccagatgaatgccaggtccccggtgaacatccaggccccaagtggaaaccaaaacctcagatgtctaggcattagaccccatgtggacatccaggccccaggaagtcatcaggccccagtggacactcaggccccaggtggacatggagtcccaggttgacacccaggcctccagtgaacagcaggccaaggagaattccaggcccagcaggccccaggtggacagcaggatccaggtggacacaaggcccccagatggatacataagaccctggtgaacatcaggctccacatggacacccaggccctagaagaacaccaggcctcgcgaggatacgaaaattcaaataaacactaggccccaggctgaaatcagttccaaggaggacactagacctcaagtgacaacctggccccaggtggctatgtgggccccagctggacggcaggtaccagaattgacatccagggcccaggtaaacaccaggccccagaaggataacaggcacaaggtagacataggccccaggtgcacaccagatcccacgtggatatctaggacccaggtgaacaacaggcccaaggtgagaatccggtctccaggagggcaccaaggcccaggcagacaccaggtcctaagaggacaccaggatacaaatggacaccaggcctcgggtggacaccaggctccaagtggacatcagcccccaggtgggtatctggccccaggtgaacacccagtctcaaggtagacaccaggccttaggtagacagtagccactgggtgaacactgtgccccaggtggacaccaggtctcaagtagacacccagtccccaggtgggcaccagagaccaggcagcctgatgagtccccaggtgggcaccagagaccgggcagcctgatgaggctccaggtggacaccagagaccaggaagcctgatgaggctccaggtggacaccaggctgcaggtggtaccaggctcccagctgatacccaggccccaggggaacacccaggccccaggtagacagcaggaagccagtgcaccctaggcacccaggtagatactaggcccctggtgaacatcgggcctcagctggacacccaggccccagggaaacacccaggccccatatgtcaggttgttaggtcccatatggacaatcaggccccaagaagtcatcaggccctggtagacactgagaccccaggtgactatccagtcccaggctgacacacaggcctcaggtggacaccgggccctaggagaactccaggccccagctgaagatcaatgccccgggtggacacccaggccctagctaacgaccagtccccaggattccatcaggccccaggtggatactaaactctcggtggacatcagcaaatgcccaggtcccaggtcaaaaccaggcccctgatggaccccctgaccccaggtaaacatgaggtttcaggtggacacgtgactctaactggatatcaggccccgggtggacacccaaccccatacggatacctaaacccccgatgaacatcaagtctcgggtgcacctctaggtcccaagtaaacacctaggcctcagaagtccagacatcgggccccatgtggaaatccgggtcccaggaactcctcaggcaccaggaaacactcaggcctcggttggatatctggccccaagttgacacccaggcctcaggtggacaccaggcgctaagaaaacgtcaggccccagctgagatcaacccctgggtggtcagtactggcgcatgctaaaacatgtatgagccttaaaaacatcatgctaagtgaaagaagccaggcacaaaaagccacatagtttgtcattccatttacatgaatgtctagaataggcagatccacaagagacagaaagtgggttagtggttgccagaagctggagacaggggagaacggcgagtgactgctaatgggtacggaacattattgggaggtgatgaaaatattctggaattacatagtttatgatgtggcataacatttaaaatatgctaacaacgactgaattgtacgctttaaaaaggtgagtctttttctttttttgagatggattctcactctgtcgcccaggctagagggcagtggcccgatctcggctcactgcaacctctgcctcctgggttcaagcaattcgctgcctcagcctctcgagcagctgggattataggcgcccgcagccacacctggctaagttttgtgtttttagtagagacagggtttcaccatgttgcccaggctggtctcaatctcttgacctcatgatccacccgcctcggcctcccaaaatgctgggattaccagcgtgagccaccgtgcatggccaaaaaggtaaatctcatagcatgtaaattacatgtcattaaacacacacacacacacacacacacacacatgaggtgggtgtggtggctcaggcctgtaatcccagtactttcggaggccaaggcgagaggatagcttgagcccaggagtttgtgacaagcctgatcaacagagcaagaccctatctctacaaaataaaaattaaaaaaaaaattagctgggtatggtggcatgcacctgtagtcctggctgcttggtaaggctgaggcaggaggatcgcttgaacccaaaatctgaggctgtagtgagctattattacaccactacactccagcttaggtgacagaggaagactccatctcttaaaaaacaaaaaaacaaaaaaaaaaaactaataaaataaaaacatgaaatccaaaccaaaaagagatgagaggggaggtaggcagagagagacagagggagagagagaccaggagagagccagggagagaggaagggagagaggcttggactgagtgtctgagtctccatacagacagtcagatcactggtatgttgtgggggtgcagttggggaaatgaggaaactccaggcatcagggggccccatttgagatgtaccatccagagtgtgagaattctaatgagtaggcaggggccataaggaccattttcttcctccctcccttccttccttccttccttccttccttccttccttccttccttccttccttcttccctccctcccgccctcccttctttccttcctttttcgtttttgaaatagggtctcactctgtcacccaagctggagtgcagtgacacaatcatagctcactgctgcctcgaactccttggctaaagcaatcctcccaccttagcctcctgaggagctaggactacaggcatgcaccaccacacccaattaatttaaaaaaatttaatagagatggggtcttgccgtgttccaggctggtcttgagctcctggactcaagtgatcctcccacctcagcctcccaaagagccaggattgtaggcatgagccaccgtgtccagcctctttataaataaaagatcagtgacacagaaaatggtttggttaaaatactttatatttcttcctaaactcttcttccaaagtaaaataaatatattttcagttataagtaaatttgctggaatgtttttccacctgctggggcaaaggtcctccccttccacccctgcctgctgcccccggtcctgtcgaggggcagatttcctccctcacagggcagacaagccacatcggggcagtgtctgccgctgcttccgaactccctgctcacggactgggagcggggcctctggcccctgagtgagctggggcaacagacttcagaatgtcgcagcccgagggagagtcacctggagagccactggggagacgctgatgtgggctgatgctggatgatggaaaacactgtgtttcgtgttttttattttgtcaggtgtgatgacagtataatgggatgatatgttaaaattcttttttttttttttgagacgaagtctagctcttgtcccccaggctggagtgcaatggcacgatctcggctcactgcaacctctgcctcccaggttcaagggattctcctgcctcggcctccggagtagctgggattacaggcgcctgccaccatgcccggctaatttttgtatttttagtagagacggggcttcaccatgttggccaggctggtcttgaactcctgacctcaggtgatcatcctgcctcggcctcccaaagcactgggattacaggcgtgagccaccgcacctggcctaaaattcttatcttttcatgtatctcaaaatatttagggatcaaatgtgtctgggccatgctggaaatactttagacaaagaaaacaggagagacaaagcagataaaacaaaatgttgataattttaaatctagctgatgggtatatgggggttccatttaatattttctctcctactcatatacgtgtgtttgtgtgtatgtgtgtgtatgcctttcaaaattctcattgaaaagtggctgatcggaagtgcaccctcaaagatgttttccccttttctccactaactcacttttttttttttttttttttttttttttgagaccaaatcttgctctgtcacccaggctggagtgcaatggtgtgatcttggctcactgcaacctctgcctcccgggttcgagctattttcctgcttcagcttcccgagtagctgggactacaggcatgcagcaccatgcccggctattttttttttttttttttttttgtatttttagcagagacagaattttgccatgttggccaggctggtctcaaactcctgacctcaagtgatccgcccgcctcggcctcccaaagtgctgggattacaggtgtgagccatcaatgcctggcccactaactcacttctaaatgatcttgttctctttgaacagaaataaaggatattatgatcttaccactttataaattagaatgatgaaattgagaaaaactagagatgactaagatgaagacagacatgaaatcgtgccaaaaagtgcccatgctgtatccagcagctgctgcagccacagaaatgctcgagttgtcagcgagggtactcactgcttgatcatctagcattgccagatactgtaaaccgccgcacacctatcagcagggcactggctacatcacacagattgctgtgccatggtttaaggtcacattgcagcagagcaggaagcatgtggctgggagtggcacggggccagctttcaggatgtatggtctggactgagctgcagtccttggggcctggacagctgctctggccctgagccctcctcccctccctgtggtctctccctttccatctctctctgctacatagcctcccttccctctctctgctctattctccttcccccatcccctttcccctcacccccaggtcaattttcttagatatctccaggcccaagtttggaggttcccaattagggtgcaggctggccctcaggtgcgtgggggtccaccttgtccagccatggctggccccagtgctacgtcacaatgtagggactgagagtggatgcggtggaggtgggcatttaccacactgtaagggatcagtcagtacagaccaggagcaggccgaatagtcagtacccgtgcagttccggaaaacccactcgttttgtgaagagcgtctgccagctcctgcatctgctagggccctgctgtgcctcctcccctctcctgccccctgggactccgcctccctcccctgctttcttttctcctggcgcttgtccccatcccacgctccaccgcgggatatagcaatgacttatttgtgtattgaggtcagtagatctcctctctatgaagacaggtccctcagggacagggctgtctgtgctggtggccgcagcagcccagcccctacagcctgccccacatggtagacaggcagctatttgctgagtaaatgaaggggtcaggggatcgctaataattttcattttatgttttatgctttccttttggtttcaactgttctgtaaagaagacattttatactagaaaataatattgctttaaaatgtaaatgtgcatggagcaacaggaactctctcattcattactggtgggaatagaaagtggtccagctattttggaagacggtttggcagttttttacaaaacaaaacatacttttactatacaatccagcaatcacactccttggcattggcccagatgaatggaaaacttaagtccacacaaaaacctgcgcatggatgtttatagcagctttatttataattttgtcaaaacttgatagcaaccaagatgttcttcagtgggtgggtggataaataaactgtggcacatccagacaacagaatattattcagtgctaaagagaaatgagctatcaagccatgaaaagccttggaggaagcttaaatgcatattactaattggaagactccagtctgaaaaggctacgtactgtacaatgccaactctatgacagtctggaaacagcaaaaccatggagacagtaaaaagatcagtgaccccccgccaggttcaatggctcactcctgtaatcccaacactttgagaggccgaggcaggtggattgcttgagcccaggagttcaagaccagcctggacaacatggtaaaaccctatcttctctactaaaaacacaaaaattagcctggcgtggtggggggtgcctgtaatcccagctactctgcaggctgaggcacgacaattgcttgaacccaggaggtggaggttgcagtgagccgagatcatgccactgcgctctagcctgggcgacagagcgagactctgtctagaaaaaaaaaaaatcagtggctctcataaaaacatcagtggctcccaggggttgtagaagggaggtgaacatgtggagcaggaagggctttccgggcagtgaaaccgctctgtatgattctataatggcggacacgtcattatgcatttgtccgaattctcacgaagtgcagcatccggaatgaaccctagtgtgcactgtggactctgggggataggctgtgtttacctaggttcttggacttaacaagtgcacccctctgtggggtgctgacgggggaggctgtgcctgttggagcggaacatatggcacatctctgtaacttctgctcagttttgctatgaacctaaaacacctctaaaagctaaagtctattaaaacattttaaaaagtagatttcaggctcagtgaggtgggagagggcggtgggggtgttcccaggcacagagggagcaggcacaccctgccctcgcaccctgggagaagctgggctggctgaacttggggaggcctggccctgggacctgcaggtagcctctggaatgcggacgtgcaggctgaccctgatggtcctgtgaatgccaaccaacctgccactcctgggctccctggcacagtcaccacaagtgtcaccccaggtcactcgcagatgcacccttatctccagaccagctggagacctggcctgaagctgagggttggcggcaggagaatggcccaggcaaaagttctcctcctaaagttgctttggaaggagggccggggagggccctcccggaccctggaagcatgaagacctccccactggagtgaagacagggagagagccaggcgtggcaggcacagccagggtgcgcacagaggatggctgcccggggcttagcatctgctcacctcatgaggttggcactgctgcctagacaacccatgtaataccccaggcctcaccattttggattgagagatgagctcagcgtcccctcacagggctctggagggtttagcaaaaggctgcggtgaaagtcacccggtccacggctgtctctgccacctgggactctctgcttcctttgcctgtgactctgcagccacttggcccggcccccagtgctgggcacccctctagatgagcgatttgccttcctctccgggtacagatgatgaaggggcctctcccggtgtcctgggtatttctggcaaccaaatggcccctgcccaggcaagagtcccgctaggaatcagcacagcctgcttgggctgagttcgtgggtggagggcatgagcttccgagaagcccctgcaggcgccaagctggggggccaccaagcccgttttccgccgtggctgcctgggtgcagcggcaatgcctgtggcgtgggctgctggcctggcctgtggggcagctgcaagtttcccttttaatggaaatctctctcttgcagccatacattgtgtttgactcgagtgtgtttttcttggctttaagaaacaggattagttgcactctttgtaatttttggtattaaaggtatttttaacaaatgcagtctgtatcgtgggaacatcctgaagttcctggaatgtctgtagtctaaagtcaagcctgttcccacccctggccttcctctttaaaggcttgatgttgttcgatgggatgtctatttttgttcatttaggtttcaaattgaagcgtgactagcactgggaaattggcattcccctgcagtcagctcttcttcctccagccccagatgtgggacggtagagcagaggggcaaaaggatcggacggcactgtgtgctctaggcagggacagctgaggggccaatgccctgcccctcccagccagaggaggatgcccccatctgttcactgcaccctccagtgggaaacgagcaaaacaagaggcaatgcatttgcagtcactacagtaggaagaggtattcgctttccaccagtaagtgacaaatcactcataagggagtgctgggaagggaagagcatgatccctttaaatgataccaagtggggaaaggaagtgctgggtagaggaggtcgtggtccctggctagggctccacccccacggacctaggtgaggacaggcatttttgtttgcctgcccaaatgttgcatttcccaagaccaccctggcctgccatgcccctgtcctgtgcctgtaaaatcccctgacattctaacaggcagacacacaacaggctggatgtggagagaagcggatcggcggaagaagacacaagcggctggacgtcaaggggagcacgctggcggaagagcacagcgacagaagagcacactgacagacgtcggcaggccacccaccctggcagaatgacacagggtttggctagggcagtcagaagagagcctgggccgctgagcgcccgactccaggggaaaaccatctcttgtctggctcccccatctactgagagctacttccactcaataaaaccttgcacccattctccaagtccaggcgtgatctgattcttctggtacaccaaggcaagaacccagatacagaaagccctttggccttacaacaaggtagacggtctaattgagctggttaacacaagctgccgatagagcaccctgtaacacatgcccactggggcttcaaaaactgtaaacattcacccctagacactgctgtggggtcggagccccacagcctgcctgtctgtatgctcccctcgaggtctgagcagtggggcactgaagaagcgagctacacccccatcgcacgccctgcgaggggatcaaagaaactcttcccatttcatcaccaccaacagcagcttgagatgacacccatttgcagcctcacagttccacgaggcaggaacttgaatgtggcttagctggatgctctgcttctgggtgtctcccgaggctgcagtcaaggtgtctgccagggcggtggtctcatccaaggctttgctgggtggggctgcccatccaagctcactcatgtgctctttggcaggacccagtttctctggctgctggaccaaggccccagctctcggctgtctctcggctggaggccgacttttgttccttgctgcataagccttccatagtggcagcttcctgcaccaaagccagcaagggtaagattctagtcttttgtagtctaatcacagtgtgacatcctcaatgtcgctgcgttctgttagaaggaagttactcaaggggtgaatacaagaccatgccttccatgaggcaggatcgtggggccacctcagacactgtctgccacagaagcgtgtagaaacgatccaccccttgctcatatgtgcattcaccagaaggtgctttggcccctggtccagagcgggagcaccagggtgaggctctgaccccctgcaatcctttcaactctcccatccctccatctcctcctctttagaacgggggtgatggaatccactgtgcagttttgtaatgtttttaaattagaggttgtattgggccattcttgcattgttacaaagaaatacctgaaactggataatttataaagaaaaaagctttacttggctcacggttctgcaggctgtacgggaagcatagcagcatctgcctttgaggaggcctcaagaaaacttccagtctttgtggaaggtgaacgggccgcaggcacagcgcatggtgaaagcaggagctgcggtcgcgggggcgggggatgccacacacttgaaaatgaccagatccataagaacccgctcactattgccaggacagcaccaagagcatagtgctaaactattcatgagaaaaccacccccatgagccaatcacctcccaccagacctcacctccaacactagggattacatttcaacatgagatctggggagagccacacatccaaactatatcagatgggatgagaaataatgaagagctggccttggcattttgctcatagtgggaacccagaaatccttgaatgaatgaatgagtttcctgttgacacaatataagtgctatgatacaaatgtatgtgtccctcccaaagttcacatgctgaaacataaccccaagttgatgctattaagaggttgggcctatggaagttgatggccatgggggcagagtgtccttataaaagacgctccagagagcttgttcagcccttctgccatgtgaggatgcagccaataaggctgcttggaggcagagagcaagcaagactcaccagatacaaaacctgccagtgtcttgatcttggacttttcagccaccagaaccataagcaaaaaacttctgttgtttataaactatccagtctcaggtattttgttttattagcagctggacagcccaaggcagggacaaagccccatttggagactttggcagcaagaaatacatgagaattccttcagaatatgtggattcctggggaagtgaaacccagctcagcccctagggagtgcggaaggtcaggcctctagcttggacttggccctttgttctagagaattagacactcaacaaagctccgcggtgctcacagctgaggctggagaagggacaacccagatgaggaaggaacaacatatttttttttctggcttctactttattttattttgagacacagtctcactctgtcacccacgctggagtgcagtggtgtgatcttagctcactatagcctctctctgcctcccaggctcaagcaatcctcctgcttcagcctcccaagtagctgggactacaggccagtgccactacatctggctaatttttaaacattctttatggagatggggtttcaccatgatgcccgggctggtctcaaactcctgaactcaagtgatccacctgcctcagcctcccaaagtgctgtgattaacaggtgtgagccactgcacctggcctctgtcttctattttaaaaaagaaacttttatgtggttataaaagtgatgctggctagcaggaagaccctaatggagaggctagaaaggaatgcaatcccactgcccagagaggccggcctggctgtgccagaatcatagagtgggggtacactttcacctggcacagccaagcccactcagacctgcccagtcagagctggggcagagctgggcaggaggaggttggagacaccccctgagtgattctgacaacctcctggttgcaaagtgccctctatgcagcatctcccgtgggtgaggtcaggctcttggagcagttttctttgtctgcttttccccatgcagcattatatcatccacattttccagtgatgttctctccctgtgactctcacacctgtaatcccagcactttgaaaggctgaggcaagcagatcacttgaggtcacgagtttgagaccagtctgggcaacatggcgaaaccccatctccataaaaaatatttaaaaattagccaggtgtggtagcaccgggctgtagtcccagctacttgggaggctgaagcaggaagattgcttgagcccgggagacagaggctatagtgagctaagatcacaccactgtactccagtctgggtgacagagtgagaccgtgtctcaacgtaaaattctccaggtgttctcccagcccacagccctcgtcaggttggcatatgacattgtaggccttttcttctgtgtttccataattacatatttacgtggcaatatagttttggattgtttttttctctttatataaatggtatcataccacaagtggcatcctgtgtcttaccagtttcccactgtgatatgtcttggtattttttccatggttggacatgtcactgacacatattcttttcattgcttcttggttttgaggttccaaggttccgagattccatagttccagggttagatggttccatgattcactggttccaaggcccaaggttacatggttcaaaggttccaaggtactatggttccatgcttccaagatgcaatggatccaaggttccaaggattaatagttccatgtttccaaagttccttggctcaaaggttcaatgttatcattgttccaaggttccatgtttccaagattcagtggttccaaggttctatgattccatggttccaaagatcagtgatttcaccgttccaaagctacatggtttcctggctccaaggtacaatggttccaaggatccaaagtaccgtggcttcatagttccaaggttccagggttcactggtcccaaggcccaaaattacatagttcaaaggttccaaagtactgtggtttcatgcttctacggtgcaatggttccaaggttccaaggttcaatggttccatccttccaagattccaagattccattatcaaggttcagtgttaccattgttccaaagttccatggtttaatgggtccaagattcaatggtttcaatattacagagttctaaaattcagtggatctgtggttccaactttacaaggttgtaagattcagtggtgaatggttccaaggttccaagtttacagggtttcaagtttacagggttctaaggttctgtggctctgtgattacaaagttacatggtttccttgttccaagattacatggttccaaggttccaaggtttcttgattccatggctccaaggttccatgtttccatacttccatatttcagttgctccaaggttccatggtaccaaggtttcatgtttcccggtttcgaggttcagtggttctgtggtttcaagactccacggttgcaaggtttcatggtcccatggtccaaggttccaaggctccaagtttccaaggtgccatggtttcagagttcatggtatcaaggtttagtggttccttgcttcccagtttccctggtttgttgcttccaagttatcaacatttcatttttcatttgcctccacctatttgtagacactcagattgcatccggagattttgctcttatcaacaacgccaccactatcagccttgctttttttttccttgtgcacatttaggagtgttcctgaagggcaaaaatcaggagcagaattgctggatcccaagaagtaatatgtgaaatttaatcaatagagccatattgccctctaatgcatctgtatcagttgcagtcttccagcagtgtatctgagtaccatttgctcgtcatccttgctatgacacaatattatcaaactttggtaatctttttttttttttttttttggagacagaatctcactgtgttgacaggctgggatgcaatggtgggatcttggctcactgcaacctccgcctccaggttcaagcaattctcctgcctcagcctcctgagtagctgggattacagtcacgtcccacaaggcccgggtactttttgtatttttaattgagatagggttttgtcatgttggtcaggctggtcttgaattcctggcctcaagtgatctgcccaccttggcctcccgaacttctgggattacaggcatgagccactgtggccggccaatctttgataatctgacggatgacaagaatatctcattgtaatttttgtttcacttgagtttgaactcttttacaatatgtttattgaccacttgtgtttcattgttacctgtgaattgtctgtttttattatgtaggtggtcttcttgttgctatgtaaagattcttttttttctttcttttcttttttttttttttgggacagagtctcgctctgtctcccaggctggagtgcaggggcaggatctcagctcactgcagcctctgcctctcgggttccagcgattctcctgcctcagcctcctgagtagctgggattacagttgcctgccaccacgcctgactaatttttgtacttttagtagagatagggtttcaccatgttggccaggctggtctcaaactcctgacctcaagtaatccgtctgcctcagcctcccaaagtgctgggattacaggcataagccaccatgcccagccataaagattctttatgtgttctattaccaattctttgcctttgttatacatgttgcaaacattttctcccagtccatcatttctcttgtagctctgtttttggtgagttttatgtattgcctgatgtatcagtattttctctctgggttcagaaacttatgtattgtattctctacttcaccaacaaagtttcctgtttttttcttttcttttattttttttggatggagtctcactccgtcacccagactggaatgcagtggcacaatctcggctcactgcaacctccacctcccaagttcaagagattcttctgcctcagcctcccgagtagctgggattacaggtatgagccaccacacctagctaatttttgtatttttagtagagacgaggtttcaccgtattggccaggctggtctcgaactcctgacctcaagtgatctgcccatatcagcctcccaaagtactgggattacaggcatcagccaccatgcctggcctattttcttcttttgtatctcatcagtattgatgtccaccagccaaagaccatctgtagtcaacaaagttaagtttattgctttgttgcaagtgagcctgcacatctaaaggagtgggtctggggacagagttagtcataggatgtcctgtcagcgtttggacagagtttgttaactgagggtcttactggaacaacgatgagtggtcttgtctttatgagttcgttttgttttgttttagagacagggtctcactctgttgcccaggctggagtgtagtgatgtgatcatagctcactgcagcctcgaaatcctgggctcaagcaatcctccctcttcatcatccctagtagctgggacttcagctcctgtagaggcggggtctcactatgttgaccaggctggcctcaaactcctggcctcaaggggtcctctcacttcggcctctcaaagttctgggattacaggcatgagccaccgtgcctggcctggtcatgtgtgttcatgggccaatttgtccatggcttattttaggacacatggatgtgaatgaactggtgttaaataatgacgcccactgtggcttgatctggcacagttgatgtgttttgtgagtcagggtatatttcgcaagctgtggtttctgttttaatcctcagtttccccaaacagactggatgcagcaggacccgtttacacctgagctgtggctttcccagtcattttcctggccagccttggctgaaggaccagctgttctcttctgagcgtgccatcatcgatttttgtgccaagtcaaatggtagcctttctgacgcctgcaacatccagcccccttgttctttctgttggatcatctgacaggacatcagctttgtggcagcattccaaaacgtggatatgcacttggctactgcaacacagataaatactaagacaagagtttttattcacaagtgaaacatatctcctatgttctgtgttctattaggagctttctcggatgaccaagtggtttcttccctttgatctggatgagatttgttcaactttgccagagtttgaagaattagttctgtatctggtgattgtcaagagttagggtcttggaagcaccaacaatgggggtgtccactggcaatggagtccctgaatccgcagagagggaaaacagccaggaaaataaaaaccagggacatgcctcatgcagagaagccccagcagtgggcagaagcgttctagtccgctgatctctgctcgtggacccctcggtcctgggaaccctgacccgcacgaggtccatggtggtggcattggcactgcccctaattgaattccctgtagtaccagtagccaccagagcctgggacagtccttgactgaggttctttagatgtttcatccacacggctcagttcccgagctttgtggatagcaggagccttggggagaatgtaaataaatgttctgtaaatgtcagttcggcccgtcaggtctagagtgtagtctaactttgatgctgctttgctcattttctgtctggatgatctgtccattaataagagtggtatgttgaagtcccctacaaaactctaataggtagtaagaataagtgttttttttctggatttaggaaagacaaagtcaaagaattgtcagagaacttaatatatgaataaggctagaaatggcaaattatacatacagataaatatatatagagaaaaatatataaatatatataacaaaaaatttttatatatgtatacatatattttccaagacagggtctcactccccttgcccaggctggagtgcagtggtgcagtctcagctcactgcagcctcaacttgctgagctcaagtaatcctcccacctcggcctcccaagtagctgggactacgggcgcgtgccatcgtgcccagctaattttttgtatttgtagtagaggcagggtttcaccaatttgcccaggctggtctcgaacccctggactcaagtgatctgcctgcctcggcctccaaaagtgctggaattacaggtatgaagacttcattttctttgcagtgattttaggataagttaagggtggagccagaataaacccagctgtattaaaccctgaaattccaatcctttcctctaatagctttaacacaatgtttttacttttagaaatgagatctcactctatcacccaggctggagtgcagtggcatgatatagctcactgcagccttgaactcctgggcttaagcaatcctcctgcctcagcctcctgactagctgagtaggcacacgccacgacgtcttagttttaatcttgtgctgtgtaagtagagctctttaatcagactgcaatgtatttttctgtgggatatatgatccaaacctttgtttcttccaaatagatagccagctgttgcaattttagactggtgtgaccatttttctgttcataagaacactttagagaatatcaagcatgtgtatctttctgttcacttacgctcattttctggagttaaatttcctgaactggaattactgggtcaaaggtatgagccttttgaggttcctggtgcatgttaccaattgttttccataaaggttgcacccacaggcagaagcatccatccttggatattctaattgtaaaagatatgcttttctagtgtggataagcaaagtagcttaacattgcttcaatttactcatctttttttatttttattttttatttttgagatgaagtcttgctctgtcacccaggctggagtgcagtggcactatcttggcttgctgcaaccttcacatcccaggctcaagtgattctcctgcctcagcctcctgagtagctgggattacaggtgcccaccaccacacccagctaatttttgtagtttttagtagagacggtttcaccatgttggctaggctggtctcaaactcctgacctcaagtgatctgcccacctcagccccccaaagtgctgggaatacaggcctaagccaccatgcccagcccaatgtacacatctttaaaaattagtgagaggccacttcatacccattgggggtgctactatattttaaaataaaaacagaaaacaagcagggcatggtggctcacgcctgtaatcccagcactttgggaggctgaggtgggcagaccacctgaggtcaggagttcgagaccagcctagccaacatggtgaaagcctatctttactaaaaatacaaaaattagtcaggcgtggtggcgggcacctgtaatcccagctactcgggaggctgaggcaggagaatcgcttgaacccaggaggtggagattgctgtgagccgagatcacaccactgcgttccagcctgggcagcagagcgaaactgtctcaaaaaacaaaacaaaacaaaacaaaaaaacagaaaacataagtgttggtgaggatgtggagaaattggaacccttgtgcattgctggtagaaatgcaaataatggagccactatgggttcctcaaaaaattaactatagaattcgcatttgatccagcaacccatttctgggtatagacacaaaagaattgaaagctaggactcgaacagatactcgtgcacctattattacaacagccatgagatggaagcgatgttattcataacccaaatgtccattgacagatgaatggttaaacaaaatgtaatataaacttacagtggaatactattcagcctttaaaaaggaaggaaatcctgatagatgccacaacatgaacggacctccaggacatgatggtcagtgaaataagccagtcgcggaaggacagtttctgcatggttccacttacgtgaggttcctacagtagtagaaatcatagagatagaaagtcgaatagtggctgccaggagctgggaagaggggacggtggggagcagttgttttatggggacagaatttcagtttgggaagatgaaaagtcctagagacggatggtggtgatggttgcacaacaacgcgaatgtgcttaagcccatcaaatctcacgcttaaaaatggttaagacgggccgggcacagtggctcacacctgtaatcccagcactttgggaggctgagacaggcagatcacaacatcaggagattgagaccaccctggctaacatggtgaaaccctgtctctactaaaaaataaaaatcacaaaaaattagctgggcatggtgacgggcacctgtagtcccagctacttgggaggctgaggcaggagaatgacttgaatccaggaggcggagttgcagtgatccgagatgcaccactgcactccagcctgggtgacagagcgagactccgtctcaaaaaaaaaaaaaattgttaagatggacagtctttgtgtgtgtgtgtgtgtgtgtgtgtttgtgtgtaggccgggcacggtggctcgtgcctgtaatcctagcactttaggaggccgaggcaggtggactgcctgagctcaggagtttgaaaccagcctggccaatatggagaaaccccaactctactaaaagtacaaaaaattagccaggtgtggtggtatgtgcctataatcccagctactcggaaagctgagacacgataatcacttgaacctgggaggtggaggttgcagtgagcagaaattgtgccactgaactccagcctgggagacagagtgagactctgtctcaaaaaaaaaaaagactcaccctgatcacagctcagtgcagcctcaacctgctggagcaatcctctcacctcagcctcccgagcaactgggactacagctgtgggccaccatgactggctaatttttaattattattattattttttgagatgagatctccctatgttgctcaggctggtcttggactcctggactcaagtggtcctcctgccttggccttccaaagtgcagagattataggcatgagccactgtactcggcctgtcatgtatattttatcacaataaaaaaatctgtgagaggaccatttcttccaatgttgattggccaatcctatttttgtgtgtgtgagttttttcttcattttctgagcccacttatgtccgagctctgagtcccaggaggccagtggaggagggaagaagaggactcggcctgagggtgacatgagacttgaagaggctcctggtggcataggggaggggacagcccaggggaggcagttccgtaggcctggcagtatgaaccccaggctgaggcaggtgctaaagaagaggccatctcctcgaggccctgaccctggaaggcatttgctgaacacccagtgcctggtgacatttggggtcctgagcccagccagcctccgaggatcagccctgcctgttatgcgcggaatgtttgcatccctccaacattcgttgttgaaattctaacccctaggggggtggtactagaaagtggggcccttgggaggtgaagaggtcgtgagggtggagtcctcatgaatgggagtagtcccctcatcagaggggcccggagagctctctgccctctgccacgtgaggattaaacatgaagtaaaaaatctgcagctggaagcggctcccaccagaacccaacaaagctgcgtcttggtctcagatttccagcctgcagagctgtgaagaatacagttctgtgtttaagccactcagtttacagtattttttaatagcagtccaatctaacaaagccaccacccctggctgggccccagctagacagaaagcctgtcagggcactctagggtttaactccccaagctcagagagcgtgttggggccagctggtgtcccacacctgggccacttatctgcaggacagggtgatgggggctcccccgtgtgtcgtgacctctgggggaggttttctagaaagtgcatacacttgctctgtacgcatctccaccctgatccagggtgctcccatctctgccccaagcacctgctccagaggacgcatggtcccaccgtccagggtcaagaaccccggaccaggccctggcccggttctggtcaggctcggccaccagggggcggtgtgggctgcaggaggctgctgtccctggagcttcccagttccagaccaggaccccaccccactgggtgggcgtctccaaggccctggtggattctgtaagctcggacccgttaatagaagtggttctctattgtcccagtcgcctaaaatgctggggacctctcaggtgtctgctgatggaaaggcagccagagccagccaaggcaattcccaagcccaccgctcagccttgcagaactgactgcacaagggtcacccaggggaaatggtttctaaaaatacagggacttccacttccaggaaaattgagtagaagtacttttccctgttcctcccactatgtacggctaaaagcctggacaccacacagaaagcaaacataagcggattctgaaaggtgaagagaagagcagagatccgtcagggacctcaggacccaaggatgacggggcgggcagctccatgtggtttcttttggcctcatatatctcactcctggagctgaagaagccagcaacctggaaacgccaacagacacagacaaaattactccaatgaaagctgctgtgtctagccaaaggaccaggaggcagcagcctcgcaaggtcaaaacgtttaggcgataacctgtctactccagccatcaccaccgaaacaccctcggccactccagcaaaggctgagcgggagcctaggctccccactttgggaagccgtggcaaggaaccccaacatctccccctgtggtgtcagagaggccaaggagggagccgagaccgccgcacccacccctgacccataccccattgtggaacagcctgagcttccaccccatctgccagtaatgccgccctctccccctccctgctgggggtgggggttggtgtcagaggaggcaaagcgaggagcctggctcttcactactactcagtggtaacgaggccaccccaatgggctgtcagcagaaaccacatggggagccagaccctgcccagagtaaagagaaaaagagctcccttgggtataaacggagattgagtggggaacctggacttttttccaccctgcagtaacaaggggccagagcagcgtcaaaaaaacaacaacagcacaacaccacaatgtttacaaaagcagcaatagaagactttggggccaggcatggtggctcatgtctgtaatcctagcactttgggaggccaaggcggctggattacttgaggccaggagtttgaggccagcctggccaatatggtgaaaccctgtctctactaaaactctaaaaattagctgggcgtggtggcgcacgcctgtaatcccagctactcaggaggctgaggcaggagaattgcttgaacctgggaggcggaggttgcagtgagccgaggttgtgccactgcactccagcctgggtgacagagcaagactctgtctcaagaaaaaaaaaaaaaatagagaagactgatgggtgtgtttattaccttgattgtggtgatggtttcatgggtctgtatagacatatgtcaaaactcatcaaactgcctattttaaatatgtagtttcttgggtatcaattatacctcgataaagctgtttgaaaaacagaaaatttaaatcagatccagagtctcataacacaaaaaatgtccaggtttcaatagaaaaccgctcattaccaggaagatggttctcagtatgatgcaacggactgaaactgttgaatgcaactaagtgaaaagggacaatcagtagatgccaacagtaggtggcaaagacgttagaattagctcacaaagattgtaaagcagccatcataaagatgcttcagcaaacaactaagaacgtgcttgaaacaaatgaaaaaatagcctcagcaaagaaagagagagaatatcttaggaaagaaattgaagatataaagaaattggaatggaaattttagaagtgaaaaatacaataactgaagtataaactcagtggatgggctcaagaacaggatgaaggggacagaggaaagaaccagtgaactggaagacagaacaatagaaagtacccagtctgaacaacagagaaaatagactgaaaaagaaaaaaaagaacagtctcaggtatatgtgggactgcaacaaaagacctaatatttgtgtcattggtggttaagaaagagaggagaaagcgtgcaaggctgataaagtactcaacaacggctaaaactccccatatttggcaagagacacaaacctacagattcagaatgaatcccaaacaaggaaaacccaaagcaatccatgccaaggcgcatcacagtgaaatttctaaaaactaaggacaaagcaaaaatcttgaaaatagccagagaaagcaataccaataccagtaccaatactctatagggaaaaaccatttgcattactgcagatttcccttcgggactgatggaggccggaatgaagtggcacgatatttttcaagtgctgaaggaaaggaaccatcagcccagaatcttatatgcagtgaaaatatccttcaggaatgaaagggaaatcaagacattctcaaatgaaggaaaactaagagaatttgttgccaaagacttacccaaaaacaccagctgaaggaagttatttaaatgggaaggaaataattaaataaggaaggaaggaaaaaaacctaataagtaaaaatgtgagtaaatacaataggcttttcttctcctcttcaattttgtaagttatgtctgatggctgaagcaaaatttattgcactgcctaatgtgattctaagtgtatgtataggaaagatttaagacaattacattataaatggggcaggataatgggatacaaagagaggtaagtttcctacccttcactcagactgaaaaaatgacaccatcagtagattgtgataagttgtatataatgtggaacatccactaaaaggctgtacaaggagctacattcaaaaacacgatggagggccaggcacagtggctcacacctataatctcagcactttgggaggctgaggcagaaggattgcttgaggacaggggttcgagaccagcctgggcaacatagcgagacccttactccacaaaacattaaaaaattagccgggcatggaggcacatggctgtgtcctagctacccagaaggctgaggtgggaggattatttaagcccaggagtttaaggttacagtgagtcatgtcactccagcctggggaacaaagtaagactctgtctccaaaaaaaaaaaaaaaaaaatgcaaacaaaaaacaaaaacaacccacactattgatcaatcaaaatggaattctaaaaaatgtttaactgataagaagtcaggacaaaggaaacagaaacaaaaaacagggagcaaacagaaaacagatcagaataaaatggtacaattgctgggtgcagtggctcaagcctgtaatcccagcactttgggaggctgaggtgggaggatcatgaggtcagaagatcaagaccatcctggctaacacggtgaaatcctgtctctactaaaaatacaaaaaattagccgggcgtggtggcgggcacctgcagtcccagctacatgggaggctgaggcaggaaaacggcgtgaactcgggaggtggagcttgcagtaagccgagatcgcaccactgcactccagcctgggcgacagagcaagactccgtctcaaaaataaataaataaataaataaataaaatggcacaattatatcctaacatatcaataattacattaaatgtaaatgtcttaactcaccaattaaaagagattggtaagatggattttaaaacatgtatcaactatatactatctacaagaaattcacttcaagatgtttcacacagatattaatcaaaggaaagcaggagtggctatattagtatcaaatgaggcagacttcagggcaaagaaacttaccagggataagactgacatgcaataataaaagggtcaatgcaacaagaatgcatagtaatcctaaacatttatctaacaaacaacagaactgcaaaatatatacaacaaaaagggatagaactgaaaggagaaatagacaaatccactattgtggttggatacgtcaacactcctctctcaacaattgatagatcaactagacagaaaatcagcaagaaaatagaagcacgcaatgatatcgtcaaccaacaggatctaattgacatttattgaacactttattccaacagcagattatcctttctttccaagtgcccacgaaacatataccaatatagaccatattctggggcacaaaacaaaccttaacaattttctaaaaattgaaatcacatggtgtgggttctccaaacacaatgaattcaaactacaaatcaacagaaagataacagaaaaacctccaaatacttgaaaactaaaccactcatttataagtaatccatgggaaaaaggagtttcaagagatattttaaaaaatacattgagctgaatgaaaatggagtacaaatgtcaaaacacagaaaaagcattgtggatggggaaaatttatagcattaaacacatatattagaaaagaggaaaagtctcaaatcgataagctcaaaaacctcaagaaactaggaaaagaagagcaaaataaacccaaggcaagcagaaggatgaaaataataaaagataagggcaaaaattaataaaatccttataaaaataatagagaaaatcaatgaaagaaagagctgattgtctttttttgtggggggagggggacggagtcttgctctgttgcccaggctggagtgcagtggcgcaatctcggctcaccgcaaactccacctcccaggttcaagcgagtctcctgcctcagcctcccgagtagctgggactacaggcacgcaccaccacgcccagctaacttttgtatttcagtagagacgaggtttcaccatatcggccaggctggtcttgaactcctgacctcgtaatcctcctgcctcagcctcccaaagtgctgggattacaggtatgagccactacacccagccaaaagctgattctttgaaaggtcaataaaactgacaaaactctatcaatactgaccaaagaaaaaaaaagacatagattaccaatatcaggaatgataactctactctatacatataaatttgacaacttggatgaaatgaaccaatttcttgaaaaatacaaactaccacaacttacccaatatgaaaaagataatttgaatagggaatttaattaataattttagaactcctaaaaaaagaaatctccggactcctatcgtttaaatagataattctatcaaatctttaaagaaaaatttatcaccactgttccagaaaataggtgaggaaagaagactttccaatttgttttatgcagctggaattacagtgataccaaaaccagacaaagatagtagaaaaaaagaaaatctcagaaaaatatccctcatgaatatagaccaagaaaatatttaataaaatattagcaaatagaattcagcactacatacaaataattgtacaccattaccaagtggagtttactcctggaatggatgactggttaaacattcaaaaagcaaacaatgtaatccactgaattcacaggctaacaaagaaaaatcatatcaattgatgcacaaaaagcatttgacaaaaatcggctgggcatggtggctcacgcctgtaattccagcactttgggaggctgaggagggtggatcacgaggtcaggagatcgagaccatcctggctaacatggtgaaaccccatctctactaaaaatacaaaaaattagccaggcgtggtggcgggtgcctgcagtcccagctacttgggaggctgaggcagaagaatggtgtgaacccgggaggcggagcttgcagtgagccgagatcatgccactgcactccagcctgggcgacagagcaagactccgtctcaaaaaaaaaaaaagcatttgacaaaattcaacactcattcataacagaaattctaaaactaggaataaagggggaactttgtcaactttgtaaagggcacctataaaatacctatagctaatgtgatactctttttttttttgagatggagtctcactctgtcacccaggctggatggagtgcagtggcgtgatctcagctcactgcaagctccacctcctgggttcacgccattctcttgcctcagcctcccaagtagctgggactacaggtgcccaccaccacacctggctaatgttttgtatttttagtagagacatggtttcaccatgttagccaggatggtctcgatctcctgaccttgtgatccatccgcctcggcctcccaaagtgctgggattacaggcttgagccaccgcgcctggccagctaatgtgatacttgatggtgaaaactaagttctttccttccaggatccaaagagaagatgcctgctctcaccactcttactcagcacagagctgggagttctagccagtacaataaggcaagaaaaggaaataaaaggcacacagacaggaaaggaagaaacaaaactgccctcatttacagataacatgattgtctctgcatagaaaattccaaggaatctaccctcaaaaaagccctcctagaactaataagtgagtttaacaaggtcgcaagacataagataaacgatcaaaagtcaattctatttctacatgctagcaacaaacacatgggcactgacattaaaaatacaataccatttaaaatccctcaaaaaatgaaacacttaggtataaatctaacatatatagaacataggtatgtgctgtgcactggtagcctcagctactcaggaggctgagaggggaggatcacttgagcacaggtgttcaaggctgcagtgagctatgatctatgccactggactccagcctgggtgacaaagtgagacctcatctctaaaaagatttaaaaaattaaattaagtttaaaaatgcagaatttgaacactgaaaactatacaatactgataggaaaaaaaagaattgaagtttttattgatccctgcaacaactggcataaatcttcaaagaattatgctaagtggaaaaagccaggcctgaaggatgatatactatatgattccatgtccacttacataacactgttgaaatcaacattctagaaatggaagacacatcagccattgctggaggttaggaaagggcttcggtgggagggaggtgcgtgtgaccgtaaaagggcagcaggagggagtctctggtgacagaaatatcccgtatcttgaccgtaccagtgtcagcatccaggctatgatgtcctaccgttgcaagatggtaccattgggtacaagggacctctctgtgttatttcttacagctgcctgtgaatctacaatgatctccacagaaaaaattcaattaaaaaatattttaaagcacataacaggcagtcatgtgtaatttgggtcacgtagaacaagtctggatcatgaagtctgtgaggctggtgtacacttaactgagagtgtgtctagctttaaaccggtatctgcatttaaaaaaaaaaaaaaaggcagagtcgggggccactctcagagagcactattaggtgctcaccggcagaacccagacattgcattttcaaagcttttaagcttttcagctgcactctgaggaaccggctattgatctgtgtccttggtgcacagcccttgcacttctttctgcccccacgccctgcggcccctctcggctctgaacaggggccctgctctctgggactccacatccctgcaaaatttgtctccccttccctgggttcctcccccggggctgagctgaggacaagggcctggcctcctccttggagaaccccacagcaccctgcatttcggcgtggtccatgggctcttctcaggggctcctcacgttgtgcaaaggggtaagggagcagggccagctgcagatctccctcccgctgtgacaaggacatcctagtcgaagagcccgtttatcttcgctcttaaggccaggctctctcaggtcattgttgccaaagaaatgaattgcagcacagctccgcaggtccctgcacaactggggcaagggctggcactgggccagcgggaacctgttggggaggctgcaaggtgcttctctgcatccaaggctgccacaccctgtgcacactgtggagctgggtggatggggtgtgctcaggaggggctctcggccctcggctgggagtcagaggcgtggtgggtggggcggggaggggtgtcacagctgcagggcagccttgatgtctgcacttggctttttaatttgtagtcacagccaacaagtgtggaaaccgcctcaggaccggcttgagtggagcggctgcgggagttacttcatgactgtggtctcacgctgtgtttcgccacccatccctgcctggcctggcttccttccttcctcctgggtacgttggcccttggctctctcctcattaactggcccctcggaccccggctggccagctgtctgcagcctcctgggtgacaccttcacccctgcctcctcgggggtctgctgccgccacatcaatctccctaacaccctgggcatgccacccctctggagacctccctagtctctctcgcagggcccccaacctgctcagcccaggcccactgccctctccctgcccggacacgtgctcccgtggcccggccgtgcctgcccacacacctgccctctctgaggttcacatgtggcatccaggggcccttccccaacagctctgcctggtgcagcctccccctcagcctcctcttccccccgagcagggtttgcagaggcccagaggctgccgggatgagtagatgttgggatcctgcttactgggcgtgtcttatcccccagagcaatggccttggaggtcagggacccagcatggccatgctggcttggggtttaggagctgtctcaccagagccccgcctcagcccacagccccgggcctgtttccttgaaggctccccagagccccatgcctggttttctggccagagcccttggcagtgacccctgctctccgcctgcagctctgggcgtcctctcagccccaagccctgataggtgccccctgtctctgtgcctgcagccttcaggagtggcccacacattggcttttatctctgggctctctgtcacctcctctccctcctgccaccctctgctcacaggctgcgggtgtggggcatccaggagctggccggtggaaagaggagcaggtgcccttacgcagtggggagcagacacacttgtgctgcttttcccttggggcttggggtggccactggggcaggacatgaggacagaccagccctcgtccccccagtgcagggggcagatctcactgccaggtgaaaccctgctgaccatccatgtggacccctcagcttggctggatgcaggaggtggttgcacagttgcaggtggggcatggagggagtggagcagccccttaccccaacacaggccccattcctgcttaaccggatgttccgaggagaagcacagcccaacaggtgtgcacaggaagctcccatcagtgctgtcctgggaaaggcccatcctgaatgaagtgtgttgctcagatccgaagagcgctgcatcttcacaggtcagggtggaaacctcctggtgcacggcccgggaggggcacccgtggcagggccagcccctgtgaggctgcacagatgagctcgagcagagagtctggggccggccacatcccacgtccgaccctgagctggggccctgggggagcccctgtggctttcgtaccagccacgcctgtatgtagagagctgagtgtctgctgtggaagaccacgagtcacatggcagacatgggcactcggcccaggcgatgctgacccatccatcagctcctacaggaccacaagctcccgttgtggtggccagagactcccaatggccacagacccactcagggctctctctggggtcttccggagaaaaggaaagctcaatgagctccttaaacctttcacttcaagttgttgcttttaaacattttgcttcgtggcctttcttgctccttctgtaaaaatctacattgtgctaccatttttttttttttttggcaaggtgtcactctgccacccaggctagagtgcagtgctgtgatcatgactcactgtagcctcaaactcctgggctcaaaggatcctccagcctcagcctcccaagtagctgggactacaggtatatcccacagcatccagctaattttttgaaaatttttttggtagagatgaggtcttaccatgttggccaggctggtctcaaactcctgggctcaagcgatcctcctgtctcggcctcccaaagtgctgggattacaggcgtgagccactatgcccactcaacatagtgattttctaactccttcatttcttctccatttagtagttggctttccaccgtaaggaaaactgcccagtctcccctctggctaccagtgaaggcttgtggggttttctttgattcggtgagttatattcagtggctgtggggcttgtttggatgctggctgaccggccccgtgtccctgtcatggtggagcacgcccttgcttcctggcaccaccgctgcacccggctcagcctgcactttaactgctgcagcgctggaggcagccacttccctgaggagccctgcttccttttgtttgtttgtttttgtttctttgctttgagacggagcctcattctgttgcccaggctggagcgccctggcaggatcatggctctttggctcagcctcccaagtagctgggactacaggtccccaacatcatacttgattacatttttaaaattgtttatagagatggggtctcattatgttgcccaggctggtctcaaactcctgggcttaagtgatcctcctgccctggcctcccaaagtgctgggattataggcgtgagccaccacgcccgaccaaggccagctttcttagaacagagtatttcttccacactggggtccaggcatgagttgtgctcactttaccatggtatcatttagatcctagaaaaaaattatttgtgagattattataatatgtataaataaatatacaattaataatactattaaacatcattgaattgtgattatattattaatatagttgtattattaatatgtgattgtactattaattttaattatcgtgtaattagttataatgcatccataataactcataccatgaattcacagtcactcctagtcctgcccggccctgcaggctcctccttgtgtccgtcattccgtatctgtacctccttctacaagagagccctaacttctaacagcatcactatgtctatcatctatttagccctccaaacacacaagacacttccagaatcttcttattctccagaggaaaatgtttcatcaaaacaccagaggcagccagcattttgacaagaaaacacaacaaacttcatttctttggaaatttgatctaggaaaatgtgtctctctcattttgctaatggatgtctgtttatcagtcagagaccatgaaacgactccttattttgaatatcagattttcttcttattctcaaacctcaaaacagcttggtaataatttatttggaaattatccgaaaggtaaaaataaaaacagaagcaagtaatatgccttgttactgctccttaattaggtaagagcctcatttcttgggctgctgggatgtaaattctgcataaaatggctggctttctttttaaggctttgcagcagtgttaacattcggctgccaactaagtcgattttaatcgcctttacaggaaccttcactttttctgtttgttccattccactctttcctcagtggataatcccgcatgttaagattcctgtgcagccgagggaggcggcttttggccgggagcttgtgctctgggtgtgagcgtggctgttgggaacgccttctgctcagaattccgtggtctcagcagatcgttcagtctagccactgggacggggccgaccgcacactgctggacctctgagcggaagatgtgtgaggttaggagggaaggaataaacaaagtcgccttcttccctgctgacctgccttggtatgtcaccattactcagctccttacagaacaggagcttcaagctttcaccggacaggctggcttcttcccgggagcccccgcccaaggtggggcctggtggggtggggccaccatcgctgctggaagctttagctcttttccctcagcttggcctcctttggcaactaattttttaactttttctaataggtaacagagtcccaagattccaagttccaggagcatgaaaggactcacttgtggagattcctgcctggggctcccacccacctaaggaatgccatccttgtcaccggctcacggggcagctctttggtatccttccagggtggtgtgtacaagtacaggcacatggatgcatggatgcatgagcatttttttcttttgccgacatattaatacacccggcagcactctaggcccattggcctgcaacttttcatttgattgatttttaattatttacttttttaaaaaattgtagttaaatatacatgacatatatttaccatttgagtcttttttttttttttgagatggagtcttgctctatctcccaggctggagtgcagtggtgtgatctcggctcactgcaacctccacagcctgatcctgggttcaagggattctcctgcctcagcctcccgagtagttgggattacaggcgcctgccaccatgcctggataatttttttttcttttgagacggagtcttgctctgtcacccaggctggagtgcagtggtgcaatctcagctcactgcaagctccgcctcccaggttcacgccattctcctgcctcagcctcccgaatagctgcgactacaggtgcccgccaccacaccggctaattttttgtatttttagtagagacagggtttcaccgtgttagccaggatggtctcgatctcctgacctcgtgatcagcctgcctcggcctcccaaagtgctgggattaaaggcatgagccactgtgcccggcctaatttttgtatttctgtagagacaggatttcaccatgttggctaggctggtctcaaactcttgacctcaggtgatctgccctcctcgccctcccaaagtgttgggattacaggtgtgagccacagcacccagaccatttttaagtgcacagttcagtggtattacatacattcacagtgttgtataatcgtcaccaccatccatcttcagaactttatgcatcttgcaaaactaaaacctgcccccattaaacagcagcccccctcatcccctgcccccaacccctggcaacccctattctactgtccgtgcctatgaacctcactactctatgcacctcacatacgtggaaccacatggtatctgccctttcgtcgctggcgtctcttagcataacgtcctcaaggttcatcggtgttggggcacgtgtcgggattttatggtgtgtgaatgacgtctcagtttaaaatgttctagagttacccagtggtgatggatacacaactctgaatatgccaacaacttctgactggtacactttgagtgggtgattgtatggtctttgaattgtgtcaataaagctgtcatttaaaataaaataccaatccgtgctggcacagagaaggactgggagactccgggcagtgcgcaggcccctgtgtctaggagagtgaggggcctgctgacctcgtcccgggcaggcgtcccaagagtctaagttccaggccttaggtctccttacgtgggtcttgtgcgcatggctcaggtggagtggcgacctgaacagtcggcactgctacgtgaggacgagtgtggccccagatggaaggcctgagcggaggcagcagggatgagggtggcatgggtgttgttatgcactgatttatgttctcccttccaaaactccacaccaaagccctcacccccaggacctccgaatgtgtatttggaggtagggtccttaaggaggtagttaagttaaaataaattcatgagggggtaggtcctgatcccatatgactggtgtccttctaagaagaaattgggacacagacatgtacagagggacaactccgggaggactcagggagaaggtgccacccgcaaggcaaggagagaggcctcaatcggaaccagccctgcccacaccttgatcttggactcccagcctccgagacaagacaataaatgcctgtggttaagccaccggtctgcagtgcctcaggacacagacacaggtggtgatgaagccaggcgagaacattttgaatgcatctagggatagaatcggcaggacttgctgatggatccaatgcaggacaagtaggtgaccctgaggattttatttgagcaaatggtgcagtcaccagtcagacgggggacccccgggcaagcacagtgcagtttctttgcaggtgcatccatgaagggtgtgatgcctaccagacattcaggagctgcagccaggtgggcagcccacaggggagtctgggcttctgggaggaagatgcagagccgtcctggacagggcagcagcagcaccagccttcactggagccggggcctgcagcctccattggtggcacacccaggtgaggtcttcacactgcctacactaaagcaaatgaacaacaaaaatcatgagagacccttggatcagttttgcacgggagaagtcatttctttcttttctttttttttttttcaagatggggtctcactctgacacccaggctggagtgccgtggcgcgatctcagctcactgcaacttctgcctcccaggctcaagtgatgctcccacctcagcctcctgaagctggaaccacaggcatgcgccaccacacctagctgtttgtttgtttgttttggtagagacggggtttcgccgtgttgcccaggctggtctcaaactcctgagcacaagcgatctgggattacgagtcactgcgcagggtggggagaagtcatttctatgcgcctcggggaagcagtgtggacaaggcccgcagggccctgctcttgggctgattcccttgagggagagcctaatgtgtaagtgaaaaatgaaatgtgcaggagagccactggtcaagcagcagtgctggggcagcaggccctgtcggggatgccagcaggctcagagcacagccaggaggagccggcctccagacaaaagcacatttgctaaaataactttgagaaattttttaatgtttttcaaatttttaccgaaatttagaaaaatttcctctaaactttgcttaaaccgtgctaaaaagtggggacaagcctgaacaaaggcctgacaccagcaaaggtcagcgagcagtgcagaagaggcgggaaatattgccaggaggtggccaggcaaggagaggcgagggaggtccccagagcgtctccccacccccgattggacccaaggcactgggtagtttgccgagggcagtgcagccaccttgggccagggtcccagccgcttgccctctgtcaggagttgctttcttttttttttttttttttttttgagacggagtctcgctctgtcacccaggctgtagtgcagtggctccatctcggctcactgcaagctccgcctcccgggttcacgcgattctcctgcctcagcctcccgagtagctgggactacagttgcccgccaccacgcccggctgattttttgtatttttagtagagacggggtttcaccgtgttggccaggatggtctccatcgcctgacctcgtgatccacccgcctcggcctcccaaagtgctgggattacaggcgtgagccaccgcgcccggccaggagttgctttcttaggtatctccttggatcatgagtttcagcgaggaggggtcgtctgcacaggaaacacgccccggccgttggagactcgctgctgcccccacgaggcactgctcctttggagtgagctggccaagcacaacacagagcctgctccccaaactgggcgggacagcgccaggcctacagtcaccacggaatgtgctctctcactcagcgcctctcctggagcctgagatggctccattcagcactgcaatcctcccagcgaaccccagccaacccaaacagccttgtttgtgcggggctctgtttcccagtcaggatacagggcagcagggcgggaaggagcctcagcagctccccagcagcacacaccaccggcctggcttccctgctctgttcgggaatctcctcccccacaccccccgcagcccccagccccccaggaacacttccccagtgggctctagcctcacctacacagcccccaccagacccctgcgcccgtgtctcagaggctgtcacagagacaaccgatggccctgcccatcatccagctggtcacgccgatgcctcccccacctcccgcaccacatctggtgccacacagctgtgaccaggtgtgactgtacacagggatggcccccatcccctctccactgtcagtgccctggccccaggcctctgctgtgcctttggggagtcctcccactgcccactctgctgtccagagacagacaaatatacattatccagtctgtgacagagagataaaagattcactaaaattgtttaaaaggatgagattctgcagattgtatttttcaaagatggccacaacacttccttctatcccacatgctcttccagaaccctgatactatctgtgaatctcagtgatctcattcccttataaaccatagaatgccacagaactgatgctacagagctcctgaggctggggcgcaagagataatgcagcatctgccttgggtgccagagcactatgcacagagacttggggccaccatgctttcaacgttgccaggctagcccacctgcacagaggtagttgccaggctagcccacctgcacagaggtggttgccaggctagcccacctgcacagaggtggttgccaggctagcccacctgcacagaggtggttgccaggctagcccacctgcacagaggtggttgccaggctagtccacctgcacagaggtggttgccaagctagtccacctgcagagatagttgccaggctagtctacctgcagagatgatataagacttcatggaaagaaacatgtccagccagttgctccagctccagccactgtctgcctggaatggcatgaactacccagctaagatatcctgaattcctgacccccagaaaccatgatagatagtaagactaaattgctattttaagtcactaagttttgagttgttatgcagcaatagataatgttatgcagcatttcataacagaataaagtgcacagagagacccacaacatgtagccaattgattttcatcaaagatgaaattggcaattcaatggggaaagtcaaatattttaaacaaatagcactcaaactattggataaattgggaggatgaactttgacttctacctaacaccgtacgcaaaaactaattcaaggtggggcgcagtggctcaagcctgtaatcccagcactttggaaggccaaggcaggtggatcacttgaggccaggagttcgagaccggcctggccaacagggtgaaaccccgtctctactaaaatacaaaaaattagccgggggtggtggcacatgcctgtgatcccagctactcaggaggctgaggcatgagaatcacttgaacctggaaggcagaggtggcagtgagcagagatcgcaccactgcactccagcctgggtgacaaagtgagatcctatctcaaaaaaacaaaacaaaacaaaaactaattcaagataaaattatagtcctaaacataacaataaaactgcaaagcttctagaagaaacagaggagaatatatgtataagcttggagtcagtaggcaaagatttcttggaaaggacacaaaaagcatgaaatataaaatttttaaattgatacattggattatcaaaattataaacatctgtttctcaaaagataacattaaaatgaaaataattctggtgtggtgactcactcctgtaatcacagcattttgggaagccaaggtgggcagattgcttgagcccaggagtttgagagcagcctgggcaacatagcaagaccctgtctctacaaaaaatttaaaaattagctgagcatggtggtggacacttgtggtcctagctactggggaggctgaggtgggaggattgcctgagcctgggagtttgaggctacagtgagtgatgattgagccactgcactccagcctgggtgaccgagtaagatcctgtctcaaaaaagaaaaaaaaaaaaagaaagaaaagaaaagaaaaacaacgaccaaaagccattgtctcaagaaaatatttgcaaggggcatatctgacactgaactggtactcatattttttattattgatttgcagaagttctttatatattcaaagttataaaataggcagaattaatctgtgattatagaacacaggtcagtagtggcctggactggggtgggggtgggagggtgggaattgactgggaagggacacggaacactttccaagggtaatgaaaataggatcttgattggggttttggttacatgggtttatatatttgtcaaaattcattgaattgagaacttaagatgtgtgtatttctctgcatgtaaatttcacctcaataaaataatttaaaataaacaaaaagggaaatgggtatccaatctgcagcaagtaggttaaaataacaacgatagctatttcagttcctttgcctttccatataaattttagaatagtcttatgactatttgaatatccactaaaaaacctggcttatatttttatattttgatgtataggaatgtatttgggcataactgacatctttacaatactgagtcttctaatccatgaatatggtgtatctctttctttatttagatattctttggtttatttcatccacattttgttgctttcagcataaaaatcctacccatgttttgttagatttaacacctgagcactttactttttgagagattataaatgatactgcttttttctttttttctttttttctttttttttgagatggagtctctatctgtcacccaggctggagtgcagtggtgtgatgtcggctcactgcaagctccatctcctgggttcataccattctcctgcctcagcctcccaagtatctgggactacaggtgcccaccaccatgcctggctaattttttaaatatttttagtagagacggtgtttcaccatgttagccaggatggtcttgatctcctgacctcgtgatccgcccaccttggcctcccaaagtgctgggattacaggcatgagccactgcacccagcccaatgatactacatttttaaagaaatacaattgatttttaaaatttttttatttttattttttgtagagaaaagatctcgttatgttgaccaagctggtctcaatgtcccggcctcaaatgaccctcctgcctgagcctcccaaaggtctgggattacaggcatgaggcatcgagccacagttggtttttgtatgtcaatcttatattcttcaacttgctcaagtgagaagaaacaatctgcctgatctcaaggcctattccataattatggtatttaaaactatatgggattagcagaagggtggacacatagatcagtgaaacagtagagaactcagaaatagatccatataaacatgccctagtgatgttttaaaaataaattttattgtgtatatttgaggtttacaacatgataggtttttttggtttggggtttttggggtttttttttgaaacagggtctcactctgttgtccaggctggagtgcagtggtgcaatcacagctcactgtagcctcgaccttccaggctcaagtgatcctctccctcagcctcccagacagttggggctacaggtgtgcaccaccacgcccagctaatttttcatatatatatatatatatatatatattttttttttttttttttttttttgtagagatgggatttcaccatgtcacccaggctggtcttgaacttctgggctcaagcaattctcccacctcagcctcctaaagtgctgggagaacgggcgtgtccctagtgatttttgacagaagttcaaaagcaactcaatgaagaaaggatacaacaaatggtgctgaagcaaccggacatatatagatgtgttaggccattcttgtattgctataaaggaatatctgagactgggcaatatataaaggaatgaggtttaattggctcacagttctgcaggcttcacagaaagcatggtggtggcatctgttcagcttcttgggaggcctcaggaagctttcaaccatggctgacggtgaagggggtcaggcatttcacgtggcagagcaggagcaagagctaggggaggtgccaacacttctaaatgagtagatctcatgggaactcactcgcaatcacaagaacaccaccaaggggatggtggtaaaccaatcatgagaaatccacccccatgatccaaccatcacctcaaacactggggattacatttcaacatgagattttgtggggacacagagccaaaccatatcaataggcaaacaaaaacaaaaccagaaacctcaatctcacatcttatttaaaaatcgactcaaaatagaatgacaggccgggcacagtggctcatgcctgtaatcccagcactttggaaggccgaggtgggccaatcacctgaggtcaggagttcgagaccagcctgggcaacatggcgaaaccccgtctctactaaaaatacaaaaagtagctgagagtggtggtgggtgcctggctgaggcaggagaatctctggaacccaggaggcagaagttgcagtgagccgaggtcgtgccaccgcactccaggctgggtgacagagcaagactcaagaaagaaagaaagaaagagagagagagaggaaggaaggaaggaaggaaagaaggaaggaaggaaggaaaaagaaggaaagaaggaaggaaggagaaaagaaaagaaaagaaaagagatgccatctcaaaaaaaaaaaaggaataataaactgaagtttagaatgtaaaactataaaactttcagggaaaaaaatacaggagaataatctctaggatctagagctagggaatgagttattagacttgactcgaaaagcaggagccataaaaagaaaaattgataaactggactccattaaaattaaaacttttgctctgtgaaaatttctctgttaaaagtggttctgttacaagaatgaaaaatcaagctacagactaggagaaaacagttgcaaaagatatatccaagaaagggctagtactagaatatataaagaactcaggctgggcgcagtggcgcatgcctgtaatcccaccaatttgggaggccaaggcaggcagattacttgaggccaggagttcgagaccagcatggccaacatggcaaaacccatccctactaaaaatacaaaagaaaaaaaaaattagccaggcgtggtggcacccatctgtagttccagctactcaggtggctgaagcacaagaatcacttgaacccaagaggtggaagttgcagtgagtcgagatcatgccactgcactccagcctgggcgtcagagcaagactccgtctcaacaaaaacaacaacaaaaaaaccctctcaaactcaacaataataaaaatccaattagaacatggacatgagacatgaatagacatttcaccaaagaggatacacaggtaacaaataagcacatgaaaaatacatcattaatcattaaggaaatgcaaattaaaaccacagtgatatcactatacatctattagagtggcaaaaaaagcctggacacagtggctcatgcctgtaatcccaacaattcgggaggccgaggcagaaggatcgcttgagtcgaggaagtggagctttggtgagctgcgatttcaccactgcactctagcctgggtgacagagtgagaccctgtctaaaatatatatataatttttttaattaaaaaaaaatggccaaaaaaggtgatactgttaaatgctggtaagaatttggggaaactagagcactcatatactgctagtgggaatgtaaaatggtacagcttctctaaaaagcagtttggcagtttcctttttttttgagtcagagtctcgctctgtcacccaggctggagtacaatggcgccatctcggctcactgcaacctctgcctcccgggttcaagcaattctcctgcctcagcctcccaagtagctgggactacagatgcatgccagcacacctggctaatttttgtatttttagtacagaactacttggcaataaaagagaaagctatcaacacacagtaacctggattaatctccagagaattatgccaagtgaaaaaagccaattctaaaacttcccacactgcatgattccatcaacgtgacattcaaaaaatgccaaaatcatggaagcggtgattgagagactcaggaggggaggagagtggaaaccgggcatggctgtcaaagggtgatgggaatgttctgtgcctcaccttgatcaacgacaacatctagcttgtagtattatgatattataatacagtgtttcaagatggcatcattggggaaaactgggtgaagggcacctggactctctttgcattgtttcttatgctgtatctcaaaataacaggtttcattttaaaaatatacaaacccttgtgactaatttaatcgacgtatcctactagagatacttttctggggagccgtggggagcctaccacacccctccttgtggctccattagcctcttctcacttagaccagggatgatggtgaggtggtgccaaggaacgtggtgggtgcagctcttactccaaagtcagcgaggagcaaggaggaggtgtttgcgctgtcacttcagcagtgaccagattgcagacagggaggcaggtaagactaggacttgaattgtgtgtggtcgagacgaggagttgaagagttaaatcctcatcctctggaatggtaagtcaacacacagtgctaaaactatttgccatggaaatgtctcccaccgtgaaagtgttcatacgcttctgttttgttttgttttgttttgagacagggtctctctttgccacccagactggagttcagcatgatcctggttcactgcagcccctatctcctcctgggctaagcagtcccctgacctcagcctcccaagcagctgggattacaggcacacaccacagtgctgggctaattttttgtattttttatagagacagggtatcgccatgttgcctaggctgtctcaaactcctgagctcaagtgatctgcctgcctcggcctcccgaagtgctgggattacaggcgtgagccaccagcgcccggcttccctctgtattttaatagtcttcagcatgatgttggccctgtaataaatatctagacaccaatgtctctctatataaagatatggatagactgataatatcatagataaaacgatattttatgattaattattattattattattttttgagacagagtcttgctctgtcccccaggctggagtgcaatggcgcaatctcggctcactgcaacctccacctcctgggttcaagtgattctcctgcctcagcctccccagtggctgggattacaggtgtgcgccacaacgcctagctaatttttgtatttttagtagagatggggtttcaccatgatggccaggctgatctcaaactcctgacctcaagtgatccacctgcctcggcctccaaaagtgttgggattataggtgtgagccactgcgcccgactgattaatttttaaaaatcacagtgggtagctagtatttgtggagccccttctctgaggccccgtggtcccatctggacctcgctgcactggggagccaccttccactgttgtcccactgtacggatgaggagcccaagctctggtccaggtgtgagcaagtgacaaggagccaaggagcccttcccttcacaggtgcttccctgcaggtggggtggccaggtgtcctcagaccgggtggctctccctcagggaccggggtggggcaggaaggaggaaggagttgttgcgcattcggcacaacccatgcctgctctgctgccagccgcgtggaagcttgattgccatacagcacagactgctgcctttctatgttgctgactgtttttaaagaggggttttgggaggggtggtatgaaattgattgtttctctctttcctcattactgttcgcacctattttgggtgttttgtttttccctgtgcttcctgtcctctgtgcactagggaagcctctcaaatggcaacagaaagtggttggtttctttgaagagcatttgaactgagtgaattttcaaaaagcgtggcattgacagaacaatgaaagtcccaggataaagtccaggccagttgccatgacagacggcatctgttgttgacagaaacatggagccaggctgaaactccggcggcaggagggctgcgcacctgggcagggcagtgccgagcacagctcccagtttgggtagccagtgggactgggtctggtaccagccttgatttcggactggagcagagtcacccagttgtgcctctgttttgttttctgtggagcagtggggggcccaccacacccctcctcgtggcttcattagcctcttcttgcctgaaccagggataatggtgaggtgatgccaaggaacatggtggatgcagctctgcctccagagtcagccagcagcaagaacgagccatgcaccatcactgctgcagtgaccggactgcaccccgcagagctctgatcgcctctctgggggctgccgtaagaaaacacctgggtggtctcagaccccagcactcgggtggctcctctgaaagagatgttgttcccgactcccagcctgtgggtagagaaggtgccaaccccacgagagtctccaggccctgggcctgcttggacctaatctgcttacagttcatgcaggttctctatccaggccttgccctcctcccagctgtttcctagtctccttcatcctgcaggagctgcttttggtctcactgtactttgttgagtaggaggcatagcagccttgagagctagaagggtccccagccatcacctgggccaagtcccgccgtggacaggtgagtgtctactgttttgtaggggcagagactcagcccagggtcccacgggctgctagcactggcgtgaggcagaccattcacctttgccgctgcacgggtcatatcctcccctctcagccaacgtgctggcccagcctggactggcccagcccctcttccctgcttctggggtcctgttcaccccacgagccctctctccagctcttcttggataaagccccatgcccaacatggtcccaggcaccggcttttggggcagtcctgggatcgccagcagatggagctcaagggggtcatgcagaccccacccaggcctggctcccaggggctcccaggagggaacttcctacccattgaaatgcaaacgctggaattccaagaagcacttcagatacatacaagtcctgattgtgtttgattcctcctctggatggaaggcttccctctctgaagtcagacgacaaagcagaggcctgggactggtggtataacccagagaccctgcctgcctggcactggtggtacagcctgggaccctgcctgcctggcaccggtggtgtagccagggaccctgcctgcttggcactggcagtgtaacccagggaccctgtctgcctggcactggtggtgtagccggggaccctgcctgtgtaccctctgtccaagtcttggggtgcccctgtattgtggtttgaatgtttgtctccacaaattcatatggtgaaaccctaccctccaggtgatcgtactagaaggtggggcctttgggaggtgattaggtcacgagggtggagccgcatgaaaaggattggtgcccttataaaagaagactggaggccgggcgcagtggctcatgcctgtaatcccaacactttcggaggctgaggtgggtggatcatttgaggtcaggagttcgagaccagcctggccaacatggtgaaaccccatctctactaaaaatacaaaaattagctgggcatggtggcaggcacctgtagtcccagctactcgggaggctgaggcaggagaatcacttgaacctgggaggcagaggttacagtgagctgagatcgtgccactgcactccagcctgggagacaaagcaagactctgtcttaatcaatcaatcaatcaatcaataaaagaagaagcctggggtcagacacagtggctcaagcctataatcccagcactttgggaggcccaggtgggaggatcacttgagcccaggagttcaagaccagcatgggctacaaagagagatctcgtctctacaaaaaatattttaaaaattagccagatgtggtggtgtgtgtctgtagtcccagctactccggaagttgagatgggaagattccttgagccagggagattgaggctgtagtgagctgtgattgggccactgcactccagcctgggcaacaaagtgagactctgccactacaaaaataaaaataaataataacaataataataaaagagggtccgagagatacccttcaccccttccaccatgtgaaattatagagaaaatatgatcatctatgaagtgggctccactctctccagacgccaaatctgctggtgcctcgatcttggacttccagcctccagagccgtgagaaataaatgtttattgcttaagccctgcagtctaaggagttgtgtcatagcagcccaaacagactatgacaccctgtattcgtttgctgaggttgctgcaacaaggtcccaccaactgggttgcttaaatgaggcggtaatgatggagggcgttcagcctgcactcagaaaggtctttgcagatggctggaggccctggagcctggaaggaggtggatctcaggaatttcacccacacacacacacatatctctggccaaatcaagttctttgcccatttttgaatcagactgtcttgttgatgatgatagtaggctctctttgtgattctcaaaaataacctcgaggatcagggcagccaagacagtcccctgaggcacaagtggggcatgggcccctgccccatgctgcaagatgactgggccctggcatgggacaggggcttctgaggatgcaggggtctgtagttggacccttggtttgaccagtgtctgtcacagtgtctgtctgggagtcacgggcccagaccctgggccagaggtcgggcaaggctttgcaggctgttttggtagcaaggcccaaacctggccaattgcatgctggccctgcaccagaagaaggagacctgcccaacaaggccctcacccaggccgagcccctgtgcatcagccctgcctccctcaccccacctgccgtggccagcacctgcccagggcccctctgctgggctccaggtactcccccgaactctaagccagcactcgaggcccagccccgctttcctggctatgcaggcttgtggcatgttgatcccccaacgtgaagccccaaggaaagagggtctctgccaccactccgggtgtatggggtcttctgatctgtgccgctgtgagatttgcggctggcagctgcagtgcagaccagaggtacgagtcctgccctcaccagtgccctccgcctgcaccccttgctggttgggaagtcctagagggaggactgggtggcacgctggcactgtcctgccaagagggccacacgcagctgctcaccaggcgagagggggcaggactcactcaagacgggcctgcagctgaatggctgtgaagatccctggctgcagaacgagcccttcggcaagagccccggggaggggacagagtaactcctttgccctgcaaggccccgcttgggtctccccaggttcagctcccaggtgcacctgatcatgcttccttctttggctgaaacctgctcggccacctctgaggggatgctggtcaaagcatgcagggttgagggctgagcctcgtacctcctgcctgcttttccggtgaggacaaggggcccctcctttcctgcaaaagcagcccctgtcttaggggctctgtctcctgctgctcccccatctctaggggaccctaaaagcctccaccactttaaaggcagcctttggaacaaggaggggcaggaatccacttcagtccaggacgtgacagccggctggccactggccacggaggtccagcgacatgctttccccagtcaagtggaaggactttggcggcatcctggtacagggtgtgtctgtctccaccaacggggaatcccctgctcagggctgatcatggctccagcctacaatgggtgcaacacatgcttgatgggaaatggggtccaacctggggcaaatgaggagcagggcagagctgccaccacgccctgcaagtgggagcaggagccctcacgcaggctggccccgctctgccaatggccctggccatggcacccggggatggcagctcctcaccctcctgacccacaccatccgcccccgcagcaatgtgtgctgtgcattctggggcaggcagagctctggctgtcctccatgggagaggcggcctctgtggcgttcagtccggggggctggagaggacacaatggcagggaatgagctgagactggggtcctcatcctcacccaggtatggccatcacctgaggcctcgaaaccaggtgatgggccgccaagttgagggctctggcaaccaccttccccgtgggagcctgggtgtgcaacaggcagtgcatttgcacgcagcaccagggtccagggaacagaggtcctgaagacgggacagtagggtcctgtttattccagagtgattttcagatctctcttgcctgactgggaggtagatgcagtggggagctggagccagtccctggagcccagcgctgagctctttgtgatggaggggtggggtgagccgcaggatctaggtcaccgtgctctggccctgctctctgcctttcgcaagcgcttgctcccgtgggatgtttgtcatgcttccatgcatgacacaggagaatatcaacattggtgccatttcacatctcttcattcatctgctattcttccaccttcagcttctcataaaatcacagaactgcagtgaggacctctgcctgccgggacagcctggggatggtcccgtgcagccccctcaggcagcatccctgtggagggttcccctccgccccctaccgtggggagctcttcccagctgagtcacactgcacgcctggtccctaccctgggctgctctctgtgttatcttgcaggcgccgtcccagatccttcaggggactctgaaggcccatcagatgtggctgcagacccacctccctcagaccctcagctctggatccaggctggctccctgccgtggagcacaggcgccctttgtagcactcactccagctgcccagggaatcggggacttggtgtggactgagactcagcccccttgaagccctattctgtccaccgctgcaagacataggcggctttaagcaggaccaggccgcaccctccaggcagagacagctgctgtgggttctgtgctcttctaatgggcatgtcttcccatcggtgatgaggactgatttgtgcagtgacccccttacatttttctgaaaaggagatcaaggaaaacattcttcagtagaatcctcactgtgcacacacttccccttgtgctcggtgacagccactgcctttgggagcagggaggacgccccagaacctcctggtctccgcacacccccctgagctgggctgagcacacaagcacccctctgcagacagtagaggttttgggattcagaatatgcagtctgaagctccccagagcctggctctttagtcaggccctccttgcccgccctgtgaatccacgcctaggagcctgtgcccccacccagcaggagctgatgctgctgagcttcccaggtgccagacaggggctgagtgtgggggccagggagccagtcgggagtctgctgcctggcaggccatgtcctgcagaagagaggccagcatagggcacggtgggcctggaggggctggagacagtgctgctgggtcggcagagctagagaagggcagcccaggcagggggcacactagtgccaaggtgcaggggcatgaagctgcaggtcacacggcctccctcggagcccccaggtactgggggtgggttcaaatctcacagggttggcgggcgagggcttcaggaacagcagggacaggagcatgagagcagtagaaaaatgcaggggtcaggaggatcatctgggacccaccaggttgctggtgaattcaggggatagaagggatgtgagctcaggcctcgagcagctgcctgattgggacagcccctggctgggccgcgaccaggtcacagcactttgcaggagtcaggcctgggctccacggtcgtgggttctagtctcggctgtttagtctcaagcagatctccaccgcgccctgacctccacttcctgcgtctactcagggtgaaaaaacaccccattcccagcacaggtcagggttgcccgagttgatcatgcaggtaggcctgtggggctctcaggtgcctgacaccctgcatgcatcttggcctcttccctcatcctcagcctcagatggactgagccatctggaacctgtcagtggtggcctcagccctaactgcagatgacaggcttgggagtgtggcgacatgtgtcacctggagcaaactgctccccctctgaagcctgtcacccacaagacctgctcccaagggccaatggcaggtgccttattctttcgtcgccatcaccgttgccacctccccaccagctccatccttctccgggtcccagccctggggcgctcactcccctgtgtgctgagggaggcccagcatggttcaaatgcagcctctggagaatttcttcactaagaggctttttctgaaaagagtcaagctatttgtagcccaagttggttgaacagatttttcttggtgtagcttatttttttattcattaacttcttttccttatgaattaaaaaatagcatttttttttccacaaaggagtgctttatttacttctttttgtaccacagccagcgcttcctctgcctgctggggaaagtggatgcacacacccactttggcaggcagttttctttcaagccatggcatcttggagaggtaagtgtgtgtgttcagaccactgccctgtggctccagcccccctgatatcagccacagccccaaggcttgggtgttgtttgtttgttttttcattttttttgagacaaggtctcactctgttgcccaggctggagtgcagtggcaccatcacggctcactgcatgcagcctcaaactcccaggctcaagtgagcctctggcctcagcctcctgagtagctgagactacagactcatgccaccacagccagttttttttttttaatttttaatttttatagaaacggggtctcacattcttgcccagactggtctcaaactcttggcctcaagtcatcctcccaccttggccaccgaaagtgctacaatgataggcgtgagccaccaggcctgcctggttggctttttggtgaacaggagcataataagggtttcactgggctgtcagcctccattgtggtggccagtatctcaaagcctcacctggcagaactggagacgcgtctgctgaccgatgccctcatgacccattttcctgacttcagaaatgtcccatgcagacactatgccatccagcaggcctcccagctagacagggtgcagcctcgatgtgtctgtggagggactcgggctgtccctgcactcacagtcatggtgaccaaagtcccagagtaagggagcagatgccgcttcccccttccagcccaggcattttacatgaggcgctgacccaggaccacccttgacttcactcttccaaggagtggctcccagtcctatatattccatcagcctccaggctggctgtcccttaaacactggtctccaatctaactgcatttctgtaagtaatcttttgggacagacttttttaaaaaagatcatgtttatgccgtattcctcatctttcttgtcttctatctccagatttgttttaaaacctattactcctgtatacatgtgcctcccaccctttgagctatgcccttgacctgctatgcacttgtctcaaggccaagttcaaaccccctaacccaaggctgtccagagctgccctgccacctgagccatggggaggggcgctgagctggtgcctttcacaggctgcctgcctccccctgggcagggctcctgtctctcctcctttgtctccacaagcacaggcttgcatgggtcagcacgtggtgaacagccaaccatcattttccaattctttccaaaaagtcctgtctatgctcagaagtcctgcctggccctttgagtgcccctacccccacacacacattcttttttttttttttttttttttttttttgagacggagtctggctctttggctcaggctggagtggagtgcagtggtgcgatctcggctcactgcaacctccgccttctgagttcaagtgattctcctgcctcagtctcctgaatagctgggactacaggcatgtgccaccatgcctagctaattttttgtatttttaatagacggggtttcaccgtgttagccaggatggtcttgatctcctgacctcaacacacatttctttatcgaaattccaaattctccaaagctcagaaacataaaggtttttcaaaactcagtggcaaagctggacctgaacgatgcgccatcacttactgtctttatttcttccagttcacctgaatacatatgttttgccccgaaaatataaatgggtctgattatgaggagcagccccaggttccaaagaggtgccacataatgtatgatgtatacaaaaaagcctgagttccaaacacatcttggatgagaggttgggactgtgggggatccctacactggttagagttctagacccagagcagggttatggtcaacggcgctctggccacagaatgcagcagagcaaggactgtggaacaaagacgcggcttacatgaatttttcacttaccgtgctgggtgctggtgattcagagatggaaaggccctagcgacacccccctccacccagggagcccacgggccagcagagggaccaaggggcacaggacgggtggggagcagaggcggattccctggctgtggaggtactgtctatacggggtgcaggagacatctccatacaagggggccctcacctggggaggtggtgaccgcaagcctgacagccccaaagccttcagagatgccgcctggggacactttgggaaagtccaggcggaggacacctgggaatgtgatagtgacacaaatgaccggagagacttgctctcagtcactgagtctggctgactcactgaagattagggcctgaacttccccctctgtaaatggggtgcaggccctggccctgccttcacagtgcccctcggtcccctacaagccttctccgcagggtgggatcgggtctgcctggagcatccccacagcctatgggtcagcagagaagcaggcgcagagctggggtgagacggtcagggccggtcctgccagacacctcagatcactcctcttcacaaataatcccattttacagcccaggaagagagaggccggaccactgcccaaaagcctgtggcctacagcctgccaggtgcgtctgctcgcagagcaggtctgcgcagcaccgagcggtcagcaggggcaatgctgggcactggccagccgcgccaggaccatccctgctgacctcggcggggtggggcggagcgtgcagggtctggcccggaaagccagggcaggctttagagaagggccaccggacggatggtccgaggaccggcatggacccgggtcccagcgagggcggggggagcgtaaggctgggcctgggctgcggcaccggggaggtggcggggaggaggccggcaggaacagccgtgcagggcgggggcggcgcgggtctggtcgggtgaccccgggcgcggccagggctgtaggaggcgagggcgtcgccccgaggccgtggtctcgggtccatggtgggggacctgggtccccgcccccccgggccgccctgggtcgcgcgtgggcgcggcgggcgccgattggctgccgggcgcgcgggcggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccaggtgagcccagcgcctgcccgcgtgcccgcgcgcgcctttgtccccgccgcccgcgcgcctctcaccgtgtctctccgtctctcccccgcccgccggcccggacccgctcggaaccggacccggactcgaccccgaccccgaccccgcagaggacaagcaggtacgtgcgcagcgccgctcccccgccgggagacccggccggctgtcacccattgtgacactagcgccttgggcgcccaggcgcgaccccgcccccgccggccctcacccagccctgtcgcgatcaccgattgtcagccgggcagtgccgccgcgcctggggcttcagaggagaggagtgggggccctggtccccggacccgcacagcagggaccctgcgcccctccccaggatggggggatgggcagagtgtccccctcccacagggccagtgccagcatctcctgctgacctggcctgtaggccatgagctgggggtcctgggtgaggccatggtcgtggcaggccacgctgggggaggggagtcaggctccatcagccagcacagtccctgaacagccctacagcagagggcctgtggtcaccacccacctcccctgcaccttcatgcccctttccctccccatacacaaatttgagtgttcaggtctgcaacagggactcttccccagattgggaacccccagggtctggtctgagtcattctgggtgcccagatgggtcctgggaccctgtgggtacaaataggcttgtggcttctcaaaagggttggccccaccctccaggaaagcaagactggacaggaggctggtctaggcacctgggtgaaacccagccgagctcagggttaaacaatgctgtgaggcccctggggtggggcgggggctgacaaccaggtgggctgggggggctggggaaagcctgctggtgtcctctctggcttgagctcagccatctttggaggaaaaaagaagagcccaattctggcaccagggtggcactggcagcccccatcagggatggagtttctcaggagccatggatgctgagtggaactccagagtcctggcccagggtgcagcaggcagggcaggagggcgggcaggggggccaggagctgggggagtcactggctgaccagtgccattctcctggaagggacacaccccacccagaggtggatgaggctctctgggaggggccccttggggagccaggctgggagctgcctccccatcacagcaggtcagacaaagcctgagatgcagggacacatgcgtcaggctactgtttgagggaaatggaaggaactgaggctgggaaagccaggaggccaggcccctgaggcttctcctgtgcctgcaggtgtccccagcttgacccaagggcactctgagaccctgggctccagccactgctgttgggtgcagccaggttctcttgcccattactgcagggtggggaccccctcctgctgaggtgcccatcgtttgaggtcaaccgggagtccacctcaccccatcccaggcctcccaggcctccaagcccagaggaagaaggcactgtgtggccaaggaagggagccccggagcaggagccaggccaggtgtctgggtgaccagtgggtctgggggagctggaagcacatggcagcttccctgctaccaccgttgctgagcctcagcctgtccaagcattctttttgctctttgaaagggggctgtagaggcattgggggagttccgtcactacgctctgtgcccccacctcctcacaggcagcaccggtgatctcttggccctggctgctgctcccagagctgactcgggtgattctaagaatggaagtgccagagaggctcaggcattgggaggagatgggcgcagctgtgtcatatggctcaggaagccctgggagtatcttttgtcacttggggaccagagaaagggggtggcaggtacggccccttccttgaggctcccccagggaatccacaggccctgactgggccccagtgggtggcagggcaggtgggttgaacgctgagagtgagattcttgccctcctgacctgggcctccccagaggctgtgccttaccaatggggaaactgaggcaggcagtctgagagccacacactctgttagacacctcctagcctgaggcctaggcccagggctgtctgtcttcctggagatgccctgggcctgagatgccagcctgtctgggtgggtgctgggcttcgaggtgtggaccctcagttggaaactgggtgggactcagcctagaggcttcctgcaggtcagggccatggaaggctggggccagtgaggaggctttctggcagcaaggactgagggatgcactggtagagctggggggcctggagctgccccctttccctgggatgaaaggctctcctgttcccagctgtgggcctgcccctcctccccaggtgccagtggtccaggccccacaacaggaccagggcctggacaggaagtggaggaggtctctcagccaggagagcctaagggagggctggtggcgggtggggtggggtggggttggggcctccagcttctaatgttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggacactgacgacgctggaggtaacaatgaggacattggggacaatgagtacactgtgggggcggtgagaacgctgtggacactgaggacgctgtgggggcggtgagggcgctgtggacgcggtgaggacgctgtgggggcggtgaggacgctgtggggaccgtgaggacgctgtcggggcggtgaggacgctgtggacgcggtgaggacgctgtggggacggtgaggacgctgtggggaccgtgaggacgctgtcggggccgtgaggacgctgtggacgcggcgagggagctgtcagggcggtgaggacgctgtggacgcggtgaggacgctgtggacgcggcgagggagctgtcggggcggtgaggacgctgtggacgcggtgagggcgctgtggggacggtgaggacgctgtggacgctgtcggggcagtgaggacgctgcggacgttgaggacgctgtgggggcgatgaggacgctgtcggggcggtgaggacgctgtcggggcggtgaggacgctgtggacgcggtgaggacgctgtggggacggtgaggacgctgtggggaccgtgaggacgctgtcggggccgtgaggacgctgtcggggcggtgaggacgctgtcgggacggtgagggcgctgtggacgcggtgagggcgctgtgggggcggtgaggacgctgtggacgcgatgaggacgctgtggacgctgtgaggacgctgtgggggcggtgaggacgctgtggacgcggtgaggacgctgtggacgccgtgaggacgctgtggggacggtgaggacgctgtggacgcggtgaggacgctgtggacgcggcgagggagctgtcagggcggtgaggacgctgtggacgcggtgaggacgctgtggacgcggcgagggagctgtcggggcggtgaggacgctgtggacgcggtgaggacactgtggggacggtgaggacgctgtggacgcggtgaggacgctgtggacgccgtgaggacgctgtgggggcggtgaggacgctgtcggggcggtgaggacgctgtgggggcggtgagggcgctgtggacgcggcgagggcgctgtcggggcggtgaggacgctgtggacgccgtgaggacgctgtgggggcggtgaggacgctgtcggggcggtgaggacgctgtcggggcggtgagggcgctgtgggggcggtgaggacgctgtcggggcggtgagggcgctgcggacgttgaggacgctgtggacgcagtgaggacactgtggggacagtgaggacgctgtggacgccgtgaggacgctgtcggggtggtgaggacgctgtgggggcggtgaggacgctgtcggggctgtgagggcgctgtggacgcggtgagggcgctgtggacgcggtgaggacgctgtgggggcggtgaggacgctgcggacattaaggacgctgtggacgcggtgacgacactgtggggacggtgaggacgctgtggacgccgtgaggacgctgtcggggcggtgaggacgctgtcggggaggtgaggacgctgtgggggcggtgaggacgctgtgggggcggtgagggcgctgcggacgttgaggacgctgtggacgcggtgaggacactgtggggacagtgaggacgctgtggacgccgtgaggacactgtcggggtggtgaggacgctgtggacgcggtgaggacgctgtcggggctgtgaggacgctgtgggggcggtgaggacgctgtgggggcggtgaggacgctgtcggggcggtgaggacgctctcggggcggtgagggcgctgtggacccgatgagggcgctgtgggggcggtgaggacgctgtggacgcggtgagggcgctgtaggggcgatgaggaggctgtggacgccgtgaggacgctgtggacgcggtgaggacgctgtgggggcggtgaggacgctgtgggggcggtgaagatgctgtggacgcggtgagggcgctgtgggggcggtgaggacgctgcagatgttgacgctgtggatgctgtgggggtggcgagggctctttggacgcggtgaggacgctgtgggggcggtgaggacgctgcagatgttgacgctgtggatgctgtgggggtggcgagggctccgtggacgcggtgagtacgctgtggacagtgagggtgctgtggggacagtgaggatgctctggggggcagtgagggcgctgcgcggacagtgagggtgctgtgggggcagtgaggacacggtagacagtgaggacgctgtgggggcagtgaggatgctttgggggtggtgagaacactctaggcagtgaggacagtcccagcagtgtgtctcgtcctctgagcatgttcaggggctggttcttgtggacagtgccggccttgaggacaccaagagcatttcaagggttgggtttcctgatgcagggactgcggcgttggcagcattcagttcactaggggagcgttggggcaggtgaccagggctggttcaggtctgttgctccatccgggatccctggaccatccgaatgagaagatggcctctatgtgacagagtcacatgcggtgggggttcttggagggccccacagcgatgagtggacctcaggggttgcagggtctctggaatcattgtgttctggagtgaacttgcccccccacaggctccaccaacacccccaaaccctcttcctgccatccctccccatcccacagcagcggccctggccccagaccccttctgccagggctcagggctggcagcctgctcctgccagccaagagccgttcctgtccctgcccacagctgctgccttccccaggctcccaggctgcaccacacggggcctgcatgttccttctgactggcacaaggtactctccatgccactgctccttgctcatctcctgtgcctctggcgagtcccccaccgggccaccacttccctcaggaaggcctctccgactgcccagaccagcaaggggcttctcagagttctccagtctctggcctcccactgccctgcccggattctggagctgagcaaacaggtcagcacatggtgcccaacttaggaggtgactgacgccttcctcactatttgggctggcctggggtgccagggacagggttcctctgccaccgtccatgtggcccccacctgtctggccttatgaacaatggaaactattctccatgcatcccagagaggccccagatgaggagcctcaggtcctggctgcccggcccaggaaggccctcagcccccaatggccatcactgaccaccactgaccgggtcggggaggctgccactgacatggcctttgtcctggcctttgtgggacaagacagatggccctcctgtggggctgatgctatctcgaggctgccagtcagacgtgaggcaggaaccacccctgcctttgtgagcaggtgcagggcatccggcccattgtgggctgcagccgactgtggttgtccatccggccttatcaccacatcgaggacagtggccccctttatacaaatgaactgcccagcttgccctccccagcggtggcctggcacctccagaggtcctagtgtaggtcagaggtaaccatcgtcataacaccgtgcatgtgcaacactctaaactcagtccaagcagggcaggggagggggtgtgctccccactttctctaagaaaccagatcccagaagggggctctctgctgggccccagagcattttttgtgtgaactggaaacagggctgaggcaggcctcttgcatcccttctctgcctcactgaggtctttggggtgcaaatgtacagcccaggagaaagtggcccagggtcttaggtggcccccagccaagagaaggacgctcctctggtctgtgggaaaaggccccagcaggagatagggggagtgggcagcccactgcttgcaaggcttgaggtctcctgggccagtgtgtcgctcagggggtggcagggggggccctgaagggcaggagctgcagaggcagagggactcctgttgaggaaagctactggaatcactgtgtggttagacctaaggaagaacttcctgcctgctggtcggcggggcagccgaaccctatgattcctccacaatccctcctcttgccggctctccgtggtttagactggttcgtgccaaggtactgactgtggaaggcacagggcttccctcgctggctgaccttccttggctgcctgggagcccccagtccccatgcctgactctgagctgaccctccacacactgaccctggggcctcagcctccaaggggtgtggggaagtgagtagtcccagttcagtatacctgaatggccctgtggggacgggagaaaggcacaccctccctgcagatctgggcaccaccttgatcccagcattgtccttcatttcacagacaacacacctgccccaggaccccctccccactgatgagctgggcccctctgtgacctcagactcttccttctaggcaggaacaggttgggggtcccgtctccaagccctgcctggaccccgcacctccagtcccaggctagctgattcagggctccttgccctgcagcccaagggccctctcaccaccattgcccaccccacctccctgggctcctgggatctcagccttaggtcaaggcccagccctggtgcaccctcccccatgggccaggccctccatgcctttgcccgcgccagtccctccacggggcacgcccttcccgctgtggctactcctcaatcttagaggcccctcccaagcccattctcacagagcttcctaggcctgccctggcctgacacatagtgcaggacagtgtccaggcctgtgtccccaagacccatctggggttcaagccacatcttgggcctatacacagccagctagtgagtgagcgagcgagtgagtgaggccctgcaagatggtcatctgtcttgtcccgcaaaggccaagacaaacgccgtgtcagcggcagcctctccaacccagtctgtgatggccagtggtggtcagtgagggctgggccgcgaggctcacagctcaggccgcacccgccggtttcacagaccggccaggaagctcccagggcgagggcctagtcgtgtcctccccatgggcgagcaaccctaggcaggcaccagagggcgctcgcggtctgcagaaaacgctggctaaggggggagcgcggaaagaggtgggcactgtgggtgcagacagctggggtccgcggagaaacgaaggcctggagcgggggcgctgggttgtccaggctggcggcgagctgcaccgagtgggacgggcaggctgcccctagtgagggcggggagggtgtcgccgcgtggcggctgacagacggggcgggatgagcgtagcccccgcccctgccctggtgcactgacagcctgtcagccgggaagataagggacttcttccgctgggcgtggggtgggggtcaacccaggtgcgctgtccccctcccgctggtgtttgctcggtaaacacttattgggccccgggctgtgcacaccgccgcgggggaggggcgggcgacctgaaggcctggactccatggcctctgccagggatgccgggtccatgggccatcaatgatgcaggaaaagaggctctgtcacctctggccccgcctggagagagttgcctgtggggtccttcgtgggccccctccagcctggggtggccctagcctcagcttcagagctgggctgacccccgactagccgaggcattaatggggccccgtggaggaggtcctgggaaggtctggggagctgaagtcctggccacgtgggggggactgcaccccctgcccagacggagcaacaacattggggtgggtggcggggccctgggggcccatagctcagcgcagcgtctgcgcccaccccctgtgtttccgatggaagacaggctgaaggtgataaatcaccaggtcccacccccacccaccctgccaacgggtggggaaggggggctgcatgtgacagagatggggaccgagacagagatgggagccaggtctagaggagagaccagagacagtggcactgtggtggccccgttgacacgggccaggacccttgcttgggtgtctggcctccccgctctgggcgccccttccacaaagcccatctggaaaccagctgagagccaccgtacccccaccccggctgacccccaacagggaggtagaggagggagggagacctttgcagccataactccgtcccccgcctgcccgcccccaggaggaccataaatcagcaggggctctcaaagcactacctccacaggctgaagggagggcttcagggccactggtcttagggactaggcctgtccttggctgtgtctgtccctctttaaacagccctcaggctgaggcaggcatatcacttgaggccaggagttcaagaccagcctggccatcatggtgaaaccctgcctctactaaaaatacaaaaattagccgggcgtggtggtgttgggcacctgtaatcccagctactctggaggctgcagggggaggatggcttgagcccaggaggcagaggttgcagtgaccccagatcacgccactgcacgccaacctgggtgacagagctaaactctgtctcaaaaaaataaaataaaaataaacagccctgaggggaaccccagtggcccccacacccagcacagtcgaactgactgagcactgtctacactggatgtacacactcacatcctcactttctctctccagacaggaaacgtctgcagggagcaactctgtgtcctcatcaggagaccccctgttgctggcccctcaggaactagggatcagcatgtcctacccagtgaagccctcctgggggtcttctctgcccataggaaatgcctccttctatcctgtcttcctgtcaccaccaccccccagggtactgagggccagctggacaaaaggtggtgagagatgggccaggtggatcccccgcaggtgagcgcaccccacacacatacacacagggcaggtgcagagtcagtacccagtgggagaggcttgagagggcctgggggagtgctccctggagctgtggggtgtgctcagcagcctagttctagccgggccggcctcagcaacccctgtccagggtctagcctacagacattcccagggttcccgtggtgggcataagggcattgtacacaaggaaacacagatgtccaccgtgacatcaccccagcttgtctcaaagagccgtggggttggggatgagggctgcttcttgtctagaaagaccttcagagatgttggaattctgtgcctgagacaggcactgactgtcactgggctggcctgggcctggttacctggactgtcgccttcatcctcagagcaaacccttgagtctagcactagcgatgtctcaggggagggttcagagtgtgcagcagctggaagtgtgctcagctcagcctgtaggagggtctggcttttccagaatgtcccagggagaagagcgcaaggggagtagggtgctggggtgtgcaggggagcccatctcccgtcatccattcacgttcaatcattcataccagtgtgcagacctgtctggagcctgccggctgccagggtcaagggctgggggggtgcagatcccttggccccagacccccacctggcagaggcacttcactcctcttccatccctcctgagagggccagctccctcctccccgcactgggattccccctagtacgaagtcctctggggctcacctaggtgtatttaagcatgtctgacaaattgagggactccaggcctaacagactggaaatgggccgggaaggcgagggctcactcaaccacagggaccagtctgccctgcccttcccaggccgcccaggtgtgactctctccactctctttgtcccagccacgcaggaccttagggccagccctgcaaggtcactgcactcctggtggggtacaggaaccctcaaagatgggaggatctggaagggaagccattgaactttgcctgatggacccatgggatgtgggggcacagaccccagctgggcaccagcaggtccccatttggctggaccatgttgacagaattagggtgcccactcctgggaggaaagcctcagtctatggctggaggtccagtgagccaggggtgagggtcccagggcagcatcagcccacagagcagaccaaggcttctgccaactgcattgcaccatgtggcagctgtacctgccagtcaggggatcccaagctggggtggggcttcaaggaggtgcctacgggcagatccagggccgagctctgcccgggtgtctgcttcaaaatctattttgatgtgctttgtatttggggagttgcttttctctatgctttgtttatttaaagatgctattgaagagttccagccaaactttgtaaatgccgaggaacgggctgctgtctgagcagggctggggagggtaggagcccctgacagccgcctgtcccagcatgcccaccccgtgcccttattgcccactgaaggtgctcgcgcggcaccaactgcactggcttcctccaggagggtagcctgggggctagggccagagaggcaccagtacgcagagcagtacgtgaggccaaggacctggtcactctgagaccaagcaggttccaggcatctatgctgaggggagtgggagaccactgactttctttgtggcaaaagtggggatggacctgtttgtgtgagctcagggcctctcttggcactaaatgcctctcttggccaccctctgccctggggtccttggcatgggactctctggtatgggaatcccaggtctatggaatgttagtctatgagtccctggtctggggttctgagcctgaagagtcctgctctgggtgtctcaggtcagcaggtctctgacaggtgtctgctcagggtccatagtctaggggtcagtgatctggccttttctccccaggggtgccaggtgccgtgtgctgccatggatgtctctgggatatcagtcagccccttctctgttggccaaggagccactgctaacaggagttgtcccagagggtcacactcttgagtctcttgtggcaaggtcaacaggaggaccatctggagcacggagagcatccccagatcataggcagaagggtgtttcctgctaaggccagccagaagactccacagacctcccaagtcctggctagactcaatcctgctgttataagtctccctgggtcctccctgaatcctcccagagccctccctgaatcttcccaaaagctccctgaaccctccccaggttgtctcctggagtcctcccagtctttcctggatcctctccacatcctccctgagtgctcccagaatcttcctgcagtcctccccatgttctctcaggcgtgggctgctgtacctggattggccctagcaggtgactcgggctggagtttggttgacaccagtggagccacaagcctgctgtgcacaggtgtgatggcaggcctgtgagggttcggggctgcatggccttgctccctttgcactggtgtctggatgtgctcagaggccccctgggtccccaggcctctgggacaaggccggttgagtctcaaaaacaggtaggaccccaagcagagccaaggcatcaccagccccagcccttgttcccgtgtgccccatctcccgaagcactcccctgtgtcatgcggtaccagctctgcctctgactccccatgcagtggccctaaggccaccccttgtcagtgtcctcctgggcctcctggggcgggcaagaacctgctcacacaggtacatgcacagcaagcatcggagggtctccttccctgggagacatcaccgccccacagtgggtcaccctcaaggctaaccactcagcttccgggtggcaagcctgcagagtggccccaggcatgccgggccaccttctaagtgtgccagtcccaccctgtgtgtgtgtgtggatgtgccagagatgtgcagtcacacttccatctgtgtcccatgcccccatgagtgtgtcctcacacctcttgccccgcctccctgctgtgtgcccctcgtagcagcttggccctgcccgctgcaccatgtgtacacagaggcttattttctctgcctttcgggccaggggcgtgctcgtaaattgtgcagtcgacgacacatttatcccgcgggcggctggcggtgtgaatttatggctgcacccccttcctggctgaggcaggacaggggccgggatacctctcaggcaggaacctccagtccactccactgggctgttgtggggccatgggggcgggctgggccgggagggcttaggagtgctcccaaggtctggtcttgcacagaaaccctgcaacttcagggtgcttggggcaatgagaggcgaggccactctgcctgggtgagggctgggggcacagtggctgcccacgtgccagaggcatggaggcccagagcccagcctaatgtcccagcctccatgcccccttccagtcggcttctcatcttcccacctaagaaagaggggacaacttggatgccccagggacagcaggtgtgggggtggctcccctcaggtgctgagtcagccacccactgccactaggcccactgggagtactgagatctggggaggactgtcagaaagggtgggggcctcgagggcagctggggctgcacacagggaagaggagcggagatactgtcgaatcagagcagagagcccctcagagctcacctgccctcctctgccttgtaaagatggggaaactgaggcccagggagagcagaggtcccaggtcacatgggtaggataacagagcctcaagatcctggattcctgctccctagtatgcaataaagggggtcctaggcacacccctccccacggagccacctttgtcctgcaaagtctggaggtggggcctccggctgaagcctcaacagggagctgatggagcaaattggcaagctggtcccatcagggccacagctggggcctgggacctggctgcctcccctccgtccgtcggtctgtctgtgtgcagggtcgggtctccaggggaccctctgtcggctctcaagctccctcccatctcggccccagccccccctcaccgcccgctgtcaggatgagcgatggccgtgcccctccccggccctcggccccaggcccggttcccgctcattagccactgacactgtttgctttcccgccatggacgcccaccccgtcacaggccattt[450 bp omitted]cccctcaggcagccccagtacacagcctggggggtgggtcctgaggcagcaggcacccctccctcctgcaccacccccgcccccaatatggccacagctgggcggcatcagggcccgcaggccagtggcagccagtccttcacttaaaaatgtgtttgtgatttcggcagcgaggcagataacggtgacgaatggcccgcctgccccccagggccctcagcccatctggtttgactttggcctgtcggcagtgcccttgggcctcactcctgccctctggcagtgccctccgagtgaggcacccctcaacctttgcacactctggttcctttgctggaaatgcccctcctctccacccatctgtccccccatcatgggctcccctggctatgcccataggagccacccatgcaacactcggggtggcaggtcctgggcagtgctggggtttgcagggtgggggagggcacaggcccagcagggagggggcatgccttgcctgggccctgcatcccctctgtctaggagggaatagtgagtgcccacctaaggccagaggggccgaggctaaggtgacggagtgggccaggaccgagagaggtggcccggcggccagggcagggcctagccctgtgagacagcccatgtggtcattgtcaggaggaatttctgacagggctcgggaccctcctgaccatcgattatccaagcaggaggagtggcttccgggtccggctgtgggctcagctgggaggtcactgaggtcaagcccgagtgcccctcctcctccagtctccccttctactcccttggggctccccagttgggcagaggtgcctggaaggttgctcctgcccagtttgaatcctggccagctaccacagggagtggtcaggggtccactagggactggagctcatgcattccttagcacaacttcccaatcaacccctgcgtgcccaggtcacagacggagtcagacctggccctcagagaggagataaggagaggtggaggtgcttagagctcccctggcccatctcaggggttggggaggggcttgtgtagagggagggcattcgggcaggatagaggaggcagccctccctgggggtctggggtcgcctccaggagaggcactgctccattccccactgcaccctccaggcccactccctgccctgtggcgaggacagctgtagggggaggggaggggcagcgccgtgtcaggacccccaccccctcctccaaagcaggaaaatccctctccgttagtatcacattgttgagaattaactttgttgaaataaaaattggtcgtggtattaactcggcctcaaggattttctctgggatcctggaggccgcagaggggtcagacgcccattcccagggccagccgctggctcgggtttcggggactccagcgacctcagatccttgggacacggtgcctggttcctccgggttgagggagccaccccagtcctgccttctacagccccggacacgaaggaggacggcccagacagtgtgggtcttaggcatccatctgtgcccctcccccatgtctccgtgtcacttgcagccatggctgttgagccacaagatgcccctcccgctcctcaggggtcagccacggccttagtttccccacatgtaaaatgggagcttcaccccagcacagggtgtggggggccctgggcacagacaggcagccggatgctcagacaccccagaaacctggggcgggcacgggtagggacagacccacccaggtctctccagagggcaccaggtggccacacaggcactcctggcctcagcacagcctcgctggccacagaaagaagttggcacccccgactgtctgccagcagggcgtgggcacttgctcccaaggaagcaagcagagagcccacgcgtgctgccaagaagggacggcagccctcaaacgacacgattccacacagacagatccgcgcaaaactgctctgagaattgctggggtcccgcccccccgccatggtccctgctggacagggggcgtgagcactgccgagttcccacgcccccactctggagtgtgtattcctacagagggagtgcccacggacagaagcacaagggatggaggtggggcctcctcagggcctgcgggtggctggtcctgcgtcccggtagccaggggacaggcgagacctcccagccggtggtcccctggaagcctcctctgctcacatcccaggcagtgtgttttcgggggtggggtgcagcctgggaacgggctggttcgggggcctgggaacgaaggcaggggcccctggcgggggatgcaccagtgggcccagctgttgctgcctggctccaattcccactctgcaccaaggcctgtccctggggccaaggctggtggtctgcctgggagggagtgagggggtgtgggggccatatcttcctccagtcagtggtccctgggcagtagaggtaggagagaaccgccttcgagctgagtggcagagcccacaagcagggggtgctctcctgtctccccaagcccaactgcagcaggtcccaaagcctgctccgagcatggaatcaccctgaggccccatcccctcacccagcacccaagcccacctcctccctgggcctgtgttggcggaccagggcctccattatacaccatgagcctggcgccagcccaagccctccaggcctctgctgtggctgctcctcctgtcgagggagcctttgcaccagggccatcctaaaactcctacttaaccttcaagaccccatgcaagtgttcctgccccaggaccccaccccgaatactgggccctgcacccagctggtgtcattctctttacaagactcctgatgcccctcatctggcacaaggctggacaccagagtggggggtgcacatttccacctccaggagcaaaaaaggctgactcctcaaggaggcctccttcccaatgcctcagtttccccatctgaactgtccttggctgacagtatccatggtcctatgggagcaagtgtgaactctgggcaggaaccaaggccagtgttctaagcagggtggagggaccctgaagaggacaggccaactgggggctcctccaaagcaggagagtgggtgcccagccagccaccccacaaacatttggctggcttcagctgaggccaagggaaggcagagctgctggcagggtgggggccagagcgggattcttcttactcctaaaatccctcccgcctgcccagcgggccccgagggaagccccatgatgcgggaacctgatattttaagacttaaagcaaatgtttctggagcccgagctgggcctcggcgcccgcccgggccttgtgggggcagggccagcgaggaggagaggacccctcccctgaaccaatcctgcccctccctggactgcagtttctggtgacaggcaggggcaaggctggaaccccttgggcaccttaaggttccccgaaacctgagggtgggggccccgttgtcggctctccgctctgctggtccctctctcggctgccagcatcagatgaggctcactgagagccctgaacccctctagggctggctttgcctgacccagagcccagggatactccctttcttaccactagcagggtgggcgtgtacaggtgctgcttttgagccactggcaggagccacttggagctcagagctgacacctgaagcttcctatctgagaggacaggagatctgggactgactggcgatgtctgcctggggtgttgcaggattcctgcgcttggaaccgcagcagatgggatcttgctctgtcgcccaggctggagagcagtggcacaatcacagctcactgcagtcttgaaccactgggctcaatggatcctcccacctcagcctcctgagtaactgggaccacagacacacaccaccgtgcctggctaatttatttttttatattttgtaggtgggatcttgcgatgttacccaggttggtctcgaactcctgacctcaggtgatcctccctcctcagcctcccaaagtgctgggattataggcgtgagccatggcacctggccatgatagggtttttttctctatatatagaagggactccccatcgcttggaccatagggcagtctgacactcggctgaggctgagtgaagctggcctgggctcaggggcatgagttccaggctccaggccccacactggtgccacctccttctgggagcctccttgggggcctttgagagcaggagcatcacaagtggaggggtgactgggtcagggacagcagagcagggaggcaggggccgtgttgggcagtgaggaattaaggcctaataatgaaggctgtatctccaaaaaatgtttcggaggcagggccatccgggcccagctgggaatgtgggggtgtaggggagagacgttctccaggttctcccagaacaggccatcctaaggacccagccagcccagtatccagcccagccctccaagcacttggcaccaaggcccttccttgtctgctctcagctggtggggctgggccaagctcctacccactagctgacaagcctcctctggaccatgtccacattttacagatggggaaaccaagggccagggtgggaacagtgcttccagagagcctacagctggcctggctgtgtggacccttcctcaccacccctgaggtcctcctgcctcagtctggaggagggacggagctctggccagctgtttgggttcgtgcagacctgagcgtgagtccacctcggccatgtcccgcctccaggcactgtctgctcacctgaagctctggctgtctcatggggccttggagggtgtcaccacctgactttggtctgctcctcgctggtcctactgccctggtggactcctgtgcacccttgaaacccactggaatcctgcctaaatcgtgagcccaggaatgccccccacttcctagctccagcgcaagcactcagcaaccctcccctgacggggaattccttgtccattgcccccaggaaacccaccagcccccgcctcgggcagtcccaggcttggccccgccacttacctcactggacagtcttggactcacgctgtgaggacagacacatgacgtcacgccgccttagtttccccagctctgaaatggagatggtaaatgttgggtgggtgttaaggccgggtgtcctgagctgcccagaggaagggcagctggcaggagagctaggggtggtgcccaccctgggcctctgcagcaccacttcccactttaggggcccagatgccatccgcagatccttggtccagcctctcactaggcctggaagccaggctgccgctgtgggtagactcctgccaggctgtgggggctggggaaatgtgcccagcggtggctgaagccaggttgcctggggaaccagtgctccccagggggcctactgctgcctccaaggccccataacacccctgtccacagctccacccaagctcccattgctttccctcagcattttctttcatcctttgggcctcagtttccccacatgtgtctcgggaaatgacagatggcagatttgggggcgaggagaggagagggtatccaggcactttgttaggattgaggtggaaagaagaggtggtcagtggaacatggggcgccagggtggggaggaaggccgcaagatccccatctgtcccctccagaggcagagtgaggttagggcctcaccagaccaagtggaggagccaggatttgaatggggggcaggatgccgccatgtgggtggaggctccctgtgcctggggcctgagtgctggccaccacctgctgtctggcgtcctctccaatccacactggccctcaacccctgtcccaggctctggttccccacctgtcaggtgaggtccttttgagcccacggcactggggcggtctgggtggagtccctgccccctcccagcctcaggcagcatcccaggcacacacagcttgcttcccaggcctctttgaggaaggtcaacggccgagaactaaggctagggatcaccggaaacctgtcccatcctcgcccccagaccctctgaccgcagaatctcctgtggggctgtaccctgggtcccctcccaggcctgtgacccggccagaggctggaggcagacaggctcaaaaccaggccccctcctcaaagcctgtggaagcccatgagatgtcccccagcaccccagggtggagctcacccacctgtccacaagcaaaggcaggcgagggcaggaggtggcagtgaggccaggcccagggatgacctggcactaggcccagcccctacccacagcccccctctgcccatccccagccccctggcccagcttgggcacccaggctccaaaccagaaaaactagacggagagcaaacaagcccacggtgcagactcccatgtctagtggaccagtgtgggcagggccttggagctggggttctgccccggcagagccctgagagccagggcaggagtgataggcccatccaaccctgagttcaaggcctgtcctaccaggcaccccacgttggccctgtgcatccctcagtggagggggatttccacccaccagcctgcaaagtgagcactgccatgccagctgccccagatgccacaggctgcttctggggagtgggcttctcatcactaggggtgtgcaaatggtgccagcagccacggcaggctggccgggtaggactgattccccaaggttctgttcagagtccctggacccaagactccagagcctaaggctctggaattctgtcccctgagatggtgacatgtttcacagtgggcacagtggtgcgcacgtcataggggccggacaaacacctgcttattcaatcagcacacacctcagtggggtccaggggtggctgggtgcctcaggctcattgcccttcaccttcccctccaccagccctccccattccctctctaagggtcaggccgaccactgcagcctgcagtgcctcacacaggtctctcctccccaggagtcgctgttcttgccccaggacccttgcacagggtcaccactggaaaccggggagggtccatctctcccgggtctgcttggtattttccagtgtattcgcagattcttagcatgacacttccactcggcagaaaggacagggagagaaggctgtgctttagggcgacggcagcagggccagctggtgagaaccatgcacaagggtggctggcagagggatgtgacatgggctcccaaacaggccaggggacctgaggcccaggatgccacctgagaggctggggagggcagctgaaggagggagggggcagggactccccccggggccagcccacctgctgttctcgcagccctgggcccagtgatgtggggctcaagggggcctcacctggaggtcagttggggagctagaggccgggacaggagctgagggccagaggggactccggagaacactggatcaagtgccatcagctgggctagttgaagagttttgtgagggtttttgtttgtttgtttgtttgtttgtttttgcgggaggggtggaacaaggaccagcatgcagggcaagatgaggcctgagggtggaggggacagaagagccctgccgggacaagggacacagggacatcggttaggtttggacccatgcacaagggctcagccacgctgccagtgccagactggccccccttcctggggcgtggcagcacattcagttatgggcacaggcaacggcaggggccagggctgcctcgagcaggggaggctgggcacccagctgtcctgtgaggacacaccaccccaccctcagaccgtgccactggacactcacatgacccaagtctggccgcttgctcactggcacccctgccaatcatgctgaccttcttcccactagcacctgctgggagctgacagaggtctctattcccagccaggcgcctgctcaggttatatttaggccacaggggtgggagctgggcctctgacccccaccatgcccaagcaggggcagctgggctgacgccgtgggttgctcactgcctgcagggcccctccctccaggccttgtcctctcatccatcggccatgtgcaggctgggaggcgcgggccggccatgcttcatatgggaaacaagctagtctggctttgagctcctggcctcgggacgatgggggctgatggcaccagaaactctagggaggccagcacaaggggacaggcccgggagctcaggttgggtggggggctggcgggaggcccagcccagcctttcagctccggaggctcagacgtgccatgaggtcattccctcctgggagctcccagagccctgcccgaggggatgctgagccccaggcccttcctgcccagccggggctggatccctcttttccctcctgctgcccaggcaggatgtttccagggaggaaatggctcctgggaggccaccccacccccgctggagtctagggccacttcctgccccgcatgggccttggttctgcccccagtctgccagcctgggccagatcccagatttcctgtccctacagcatggagaggcagaggtgtctcggcctcaaccagcctgggaggcacagtcgcaacctcctggaccccaggacctgagaacctccccctggagccccacttcccttgccccacaaccctggtcagagggaggcacgacctgccctgcccccatgcccagccttccccagcgccacagagcctccttcatataggttccgcttgggtaccagctgctgctccaccgcccatctccatggggcccgcgggcctgggccatccccagcccaccccaggaagctgaatggctgcatcgaagctcccttttggctacaatcctgcagggctggccttggaccagcgggttagcctggatctgatgggccctcctagcagaggtcatcacccggctccgtgggcagccccatccccaggggaggtcaatcagctcagtcctcacccaccctattcaatggggcttcctgccgaccccagatctgggtgagtgtcctggtcaccgccccctcgaccaccaccccatgcagcaggaaacacgtagctggggggttgtggggcttcaggactgggattggagaggctgacagcagggctcagggctctcggcggaagtggggcctcagcccactcagaggtccaggaagtgggggtctcggaagcttcctctcggccagacgagccggagggtcagaggcctggccgcagctgccccttcctcttcggccagccagctgctgggtggcccgtgctgcagcaggcctcaggttggggagctggttgtccttcagcccccgcaggtggccagcatcaggaccggaaggctctgaatcagcctggtctggaggtatgggcagctgtgggggccggtggacaggtgtagcagagctcagggcgcacagcaggggccatctcagcctgggcctgtgttcccttcagtcagacctctctccagcctcggcttgcccatctctccagtgaggtgacaatcccgggcctgaccagacaggctgaccaggacagagaaccctggggccttctaaggccactgccatgtgggccgggtcctgtcagacacccccagccctcagcccctgacccatttctgttcatgccctggccctcctgcatgcccacccaaccccactggagctcagagaccctgcccctccaaggccttttctccacagccaggaccaggcccccagatctggtgccccatcagtcctgccggtacacctctccacagaagaagcccagacccaacccagcctgcgtgagccctgctggggggcctgggccatggaggtccccagccccatgcttcaggggaccgcagcccagtcaacccaggctgcagaggtgtgaggagggggctcttgcccttggcaactggcaggagctgaggaggtgcccgggagaccccatcctcacagatgctgtcatcctggcacatccctacctgcagtggggacctggacaactcatggaaccagtgggagctggaggctccaggcattgatgtgctgggcctcagtccctatgggtccccactgtgggagtgtctcagagtgggatgaggagtctgtgtccgtgcctgggccgaggcctggacaggccccacccccggcccacacatgatgggcggtcgtccatcagcacagccagcccctctggccatccatcaccagccagcggccacaggaggaatggcctgtttgttttgccagctccgtgtcactccctggggcgggggctggaggaaatggccattttctgcctgggcgggcgggtggacagcaggggtgggcagggcaccggggacagggatgtggcaggaccctggctcatcccggccctgcatagatgcccacagccttgccctgttctgtgcctcagtctcccctctggcatcagggtgagtgacactgggattttctgactgttcccatggcagctctctccagctgggtcactcacccctgccccttgccactgggtagggtgggctcaggtgtcagctgccaccaggtggggggtccccctatctgaaatccaagatgcttgatgctggctgttcttataaaccatggggggaggctctggagctaggtccaggccataggccaactgttgattggggttggggtgggggctgtcaggaggtctgaaagggcctgggcaccgatttggagacttccagccttaagatcagagcaggggacagttggggccacattaaaaaaggtagcacgtgtagaatgaagggggagacatcctgtaccaagaggctggtgtccagaccccgggactgtgtcctcagcacctgcacaatgaccctcactgcatcctcatggtagaatttgcagatatgatgtagaggtgtgcgtatatgtgtgtaaagggatacatggcaggtataatttgctgacaccatgctagggactctacaatcattttatcacttctcacaacacctacaaggctccggggagtcaaactgggatatttcttttaccactgcagcctcagacctctgccctggtccctgatccagaacacagtcaccccacactcccctggtcctgggctagcaaggagggctgtggaggaggcaagcaagctccaaagtgcagcactgaggctggggcggagacactgagagtccgaaggcacctccatccctaggaagcaaagccagacacccaattctggagtcagaaaaaagcccttcaatttccatccctgcagcccagtgtcccaccaccctcaggggagaagggtcgctttgctctccctggggcactgtgtttgcttacctcccaggcagctctgatgttgcatagctctttttcatttaggagcagtgacttccttcccgaaatttcttcccttagacctgggctgcttcctctgaccctgcacagccctgcagatgtttgcagggtatcgccctattttatctccctagactgaaacatactctgtcctgagttaagactctggctggttgtagcagactttaaggaaagaacttaattgcaaaaattcactctaagtgtgggcgtgactaagactcattgtgtcttgaatgtgcagagatggataggaggagctcgggggttagtgacattgaggccacatgagggaactctcgtgaacactcagttgaagggttctggagttgggaggctagtgaaccagtcccaccagtgcagggctgacggccctgtgtccagagacccccaagcccagcctgttccttgagccagggctgccgtgcctctgcccagcctccagctcacgagggctggcttagcgggattcatgtgccaccccctcggtgacatctgagaccatgcacgtcttggttgtgccttgttgctctctgctgctctacacagggagacaggccggctggtcgcctcgggggttatcttccctggcccccgaagccctggtgaccctgagcctgacccagggggaacaatgacacaacagcaaatgccctggggcgagtgccaccctgacagccccaaggaacagagagaatcagcagggtgcagggctcagcaggtgcaaggggagaaggctggcttatgtggtggtggggacagggcacagggccgggagggaggggacaggtggccaggggctctgtctacatgggagccacatgggggtgtgggtgggcactgcagagaggggccctggtcatggggtccacaggagagccaagccagcctagaggatccagggatggcccaggtgctcctgccccacctgttccaggccagctgtgtcaggggtactgcctccgtttctccaggctgggacctccactgcagtgggtacattggacactcagaccagccccagggcctggcagttcctggtgaagactgagacagcccgacacccgtccacacccccgcccaggatggggtggctgctgggtcactcggtcctggcaaacacgctggagggaggggctggattgactttagggcactggtaaaagctcacatccatctgtccacccagaacagctggtgccaagcacccacttagcaggacagggcagcccgcgcctccacactgcccatgccccctcccgtctcccaggacgtccacacaggagccacatgtgtcctggacccacgccaccccccgctctgtccctctgttccctgagctgggctggcaggggaagctgaggtgtacagggatggccaaggcctcctccctcccccctgcaccccctagccccattggcattacctcagagcagacaacagcttagtggggacccaagtgagggggtgtcagtggcccaggccctgccctgcccagtcactcaggcagctaagagagcaggaagggcccagacgacacccccacagacatatgccagcccctccgggtgaccaaaatcatctcagtaaaggcagatgaggccaagcgaaaaggggtgggtggaagaaccggctctgagtctcagcccacagacactcggacactcgtcggcccggtaggcaggggttcctggtggcctcaggctgtcaggcccggccccctcccgcagctgtctccagctcccacctcccccgcccaccccccaggactcctatttcactgaggagattaagaccacctggcgagaacccctcccacccctcccctctccccagccctccctcctaaccctgtcggccccttgaggtgccctcccggccccggccctcctctcccatccccacgttcctccacggcagcctccacgccctgccctgccctgccctgccatgggcctgaggatgtccccacccgctctgatggccacctcgggtcacttctcctcagcccataccctggcctaacccccaccctgagcctccagtccctccaatcctcaccctttatgtcccccagccctgcatagatacaggcatcgtcaccagccacggcaatggatcccgtccacctcccacccggccactccagacccaaattcagcactggcttcagcctcctgccattcttgctgggtctcaggagggaaccgggccagccaggtgctgtctgggactgtaggctctgagcctggtccctgctcagttccagcagccagtgggccaggggtgctcagctgaggacccccactccatccagcctgccgtggggcagccggcctggcctgatgctggctcagacagactcatgaggaatctgagctctgaaaaccgcagctccgagcttgcctgtttgtttgcttttgagaaattccaacctggttcagcagagccttggaggagggaagggatttgtcaggtctggggtggggctggggcaggcttgtggatgtggggaaaccaaggctgaatctgggcacagggacccagtggggaagccgggagagggtgcctaactgggcctcctggggggtccagctgtgattccccctccccaaacctcacgccaggcctggaggctccacaggggctatggaggcaacagccaccctactcacagtgctgggaggacctgcggggctgggaggggcccaaggaggccctgcagcaacaatagtgacatcagctggggagctgcaattgagggcccacatgtgctggctccatccacccatggggcctgcagcattctccccacttctcagatagcatcactgaggcttgcagaggccagggcgtgttcccagacacagagccctgaagggtgaagctcgctcctggacccagctcctgagactgggcgacatcaccacgctggttcctccctgtgcagaagggcccagagtacaggggtcctgccgaagcagtcctgttctcctttgaaatgaaatattgccagccttctcaccagctccttcccctgggaaggcgggagaccagacagagttggcagcccccagccctgcatcgccaccccgaccagggaaagctgcctgtgcaactaatctctccaggccccggtccccctctgcccacgggcttggggatcctccacaggtctcagcaaaggggttcccgtgctagagccttgcccatcagggacactccccaaaacctgccccagcctgggcagcccacctgcctttggccccaggtcagtgagggcgcctcaggtcagcccccacaagcacagggggagatatgagcagggtctgcccagagcagtgggcagggaggctcaaatgccagcctgggcacctgggcacagtcctggcctaggagggacaatccagcagccttgggggcttggccagggagcagagtggaccgagaggcacagggtgtggggccagtcctcccctccactgagacaggatttccacacagtctctcccagcagtcacactgggctgtcacagtgacagtatggactacttgaatcaattgagcatttaatgaaaactgcaagtgtgatatatttgactactttaaatgctttaagcatctttaaagagagatacaacatatccaatgtttacgggggcatggcctcgttaggacccattaacaaaggtgctgaggtcactggcttagttgtcattcctcattgcctctggccctgtccccagagccttccttctcagagcttcccagggctcattcgccaccaagcaagattcagggttggggtctgagcatggaaagtggcctcccaaggagttccacccagaaggttctctgtagaccgatcttgtcttgagagtctcttccagtaccaatgtccaaggaagcaggctggccagtcggatgccatcatccgagtgcatccccttcagaaatgacccagcaggagaggactgaaatattgcattcttccttcctcacacagcagcaagcttccacagtgcttcgcccaagtcaagtcaatccaaggcacatgtgagcatcgtcattattgtagaagggttacagtggccactgtgagtgataagcctgcacatgtgtgcgcctgtatgtatatctgctacatgtgctgtgtgtgcacactctctcacactggtgtctgtgttggtgtctgctatgtgcatgtgtgtgcccatgctcacgtgtgtctatgtacagaggtgcatgcatgcccgtgctcacgtctgtgtacatgtagagtgcccatgcttgcgtgtctgcaggcatacagtgtgcatgtgtgcgtctgggcccagtccgtgtgtctgcatgcagtgtgcctgtgtgtgcccatgctcacgtctgtgtgtctgatatgtgcatgtggacacatgtgcccatggtcacaatattggtatgctcacatgtgtaggcatatgtgcccacactcccatgtatgtgtgcctgagtatgaacatggtgtgaacacacacatacactcatgctcatgctcatgagtatgtgtgcacgtggtggtgtgggtgcttgaacatgggcaaatgggagctactgtccagtcagggttccctgctgcccagaggaactggaggggcctgtctgcacgtgtccatcttctggccactcaccctcagccaacactcctccagggtcttttgggacaagtcccttcccctggcaagtgtggctccccctgctggggccacagaagggaagggggctagcagggactggttcctcagctggcccgccaggctgagatccagccacctcaccagcctgcacataggtcttccagggtctcagagcctcacctctgcctggctgcacctggggtggaggggctagtgtggccaggagatggacagacagatggacagccagctccccatgtggctgggtcctcccaccaagtgggcagctaaatcaacagcctcagaaattggagaggggtccagggctgggctgtccatcagtctgtctgtttgtttgtttgttctggagttgtgggaacttccagtctgcagggagtcctggtgcctggcgaggtcggggggcagagggtgccattacccatccggccagccatccctctcatcatctccccacatctgtcctcctgggaacttggcccagaacatcgcacccatagttgcgggggacagctaggccgggtgacaggaggttggggaccagctgtatgcggctggctgtgcagaccctggccggccccctcccggctgggaggaggctggtgtcacacggctgtgtgcttccctgtccagtcttctctccacccattaccccatcccatgtctgcctctctcagggtctcgctgttctctttgtcaatcctgcagtcttttgtcccccagggtccaggcactaggactctcaggcgggtcagaccctgccctgggaccagggagcagatggtgctggggcctaggaagagtcccaggggatgctctgggccgggtgagggggccacacctcctgtcatcctgtccagtgtcctcccagccacaaggtgtgcacaccaggctgtgtctaactcccaggcctttgccagctatgtggtcagcctggtcctgaccagactcacagggacacctcctccaagccctgggccccttcctgggaacgtggctgtgggcctggagctcctgggcagggttcctgcctgctgtctgacacaccccccagagcttggaaccagccagagtacccacgaccccagcagtttgagtaaaggcccaacaccaaggagaacacgtgggggtgggcttggtgaggacttccgtgtcaggaggcgggcgccagggaggagagaggtccagggagggcaaggtcaaggagcagtgggaccacctgagccacaggttggggaggactcccattgagaccccaggctgggtaacaggaacggcctccttcttcatcgcaggcagtgtttgcggtggcacaggagatccggcggtggacccaaatgcgccctgccctggcaggcagggaagtagaccgcttctgtctccagccctccctggaggcggacctggcccctgttctggctctggcttgggtccctccactccaggagtccccagcccccagttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggagggacgattggggagcgcccgaggctgctgtgttggcgcccgcccccgagggctgggagtcaagaggtgggagtggagaggggaggagagggcagagctcctgggcgcgcggtcctgtccgggttcaggcgaggtttgggcccccagccgcccgcccttctctggggcccggggctgagctgctgatggcgggagggaggacggtgagggcagctcctggcggcgggccttccccgagaccccgaggccgcgtccaaatagggcgctgtaagcaactccaggcggtccatcctaaaacgaattagcagggtcaagtaaagcccggctcctcagtgcttccctttgcacggtgcgcggcggagcccgattctgctctctccatactctgaggcctagaggaggagtcccccgtgcacctcgaacctccggccggtcccttctgtgtgtatatttgccccaagtagcctgggaccaatgctgggggcgcaacttgcctgggaaacacagcccagcccaaagatcctggtatactgtctgcccaccagggacgcacgggaggtaaaggagggtgcgcggcaacccagcggtgctcagaattctgagcagtggggaggtgctgtgcctttatggataggaggggaagggggtcctgctgggtgggcgtgagggtgcctgtctgaaggctcccctgagggagccacgtgtgtgcaggggaggcggaactgggcagacagatgggcggccacaattctccagcggcagcctacctgcgctagggaaaaaaacttctggaattagggtttgcttcacccacaactacgaagactggggtggggggcgagtctcagcacactggactcccttggggcagggctgaggtgcagcccagacagcaaaggccgccgcgggtcctcggtcgcatccctcccttcagcctcctgcactcagccaagcctctgctccccaccccttacctacccgagtggaagccaagcttcggttttccggcctgtaaaatggtatcatagctcccatctcgccccctgcgctgggagaaatgggcgtcttgtcttcgctgcgcattgcatgcggaggagcagatgtctcagcccaggccctagccttgcatcgagccctgaggaatcagaccctgcgacccctagccgcgcctcaccttcctgatccacgcaagggagctcccagtcaggcctcctatcgcgcgggtgtggaggtgcggccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacacaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgcctcctgccctctgcccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaacaaaacagcttatgagcacctcctactaatttcctcagcttagcacaccctgtggccgttgtccccatcgtccgtggcttcatccctcaactgatgctttcctatgtggacttcccggccagtgctgtgggacctcccctgtagggctggccagcctcatgggctgggctacccgtcccactcagcagtggctgcctggcctcccctctgtccctcctgcccagctcctaatgggcctcccataaaagctgatgcgtgggagccaagccacagctcgctgacctggggaagctgacagagtgacagagggtctcaaggactctccacccacaaggcgggaatggggatgctggcaaatctggtatgaaggttgagaccccgaggagaggcaggcctgggggaccgtgcagcagctgtgcccacctaggaccacagggctggtggggctggcagcttggtagagggcaggtgcacagcaaagttttcaccggtgccggcttgttgtcttccacgctgggatttcacatgaagttctagctaattgagtataagcatttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccggcatcggctgacccctcggtgtctacgtgccaagcccaatctgcctgcagggacacccactgccagaggcggaggcaggttctcctggtcccagacccagggccgtctgttggcctgcaggtaacacgcagggaggaaggaaaaggctctaggcacagctgcttgtctaagagggaccctgttggcggcgcaacgctgggtgagtgctgcccgcccgcggatggggtgctggccgaacctaccttgtaaagtggggctgcacagaggtcagcacatggtggcgcccaccgtcgagaggggaggccccttggcactggaggcagggcctcaccaggcagacgtgccaggacccgcgtccctgcacacagctgcccaccggccagtggagtgggacctgctgcccctctgacagctcctggtaatcagaggggcccactccacctgcaccggaggcagcggctggggatgctggagcatacggctccagccactcaggatcccactctgggccgtgaaagttactccacagaacaccccaaggccacccctgctggctgtgaagacaccaccaggcggacagtgcccagggctggggctcacagccacgagaatctggatttgaacagaaaaagcccccagccgcgctgccaccctgacgcagccttgtggggccctgagcagaggaccagctacgttgtgcccgtgcctcgacacatggaaattcttccaataagaacaggatggtgggccgggcgcagtggctcaggcctataattctagtgctttgggaggctagaggcgggaggatcgatcgcttgagcccaggagttcgaaaccagcctgggcaacatagcgagactccttctctataaaaaaaaataaaaaattagctgggcatgatggcctgcacctatgtgggtggtcctgagcttctcgggaggctgaggcaggagaatcgcttgaacctgggaatcagaggttgcagtgagccgagactgctccattgcactccagcctgggggacagagtgagactctgactcaaaaaaaaaaacaccccaaaaacacaggatggtagaacacacctacctgagttggcactgaaaatggcaagaaatgtccgccgttgtttccaaacaccaagttctctctggcttgagaggcctcactgctacccaagagcattatggaggaagatgtggaagggctgcctctcccagttggtgggttggccaggggcgtgatggcagcgaccagccatgctgccaggagtcgcctctcaggttcatcccaggagctgcatgctgaccttcgcgtgctgcctccgggccacccctcctccccacttaatgccttcactgctggctctgttggcgttcctgccagcctacaggaagtggctgtttgctaggaagagaatgccaatgttcaggtgcatcttttccaagctggatgtctggagctgagaccgtttcttcttctgttgtgggggtttcaaggctggtcagacgcatggtgattcatcacgacccaggttctgttgacacaaaggccgacctgtccagagccacatggctctgctgtggacaccacggagcagctcaagagaggaacaggaccaggagggctgcactgctcttggccggcttggaccccagcaccggttctgctgctctcccaggcagctcagccaggtgaatgaaagtcctgggcctgccctccacaggacgtctataaggcctcagaagctggatctgcctggcaaggggggccctatctgcctagccacccagatgcgggcacgtggccccgttgtgcactggaggggtgagggctgtgttaggcatgcaggactcacgctgtcccgactccatccctgcacactgagattcagaacaagatgtgcctggacactgctcaacgccacatggcctggggcagggagctcaaggccaggctagggggcagccgcctgccatccaccctgcttgtgcctttgactgaaagcacgagggccaggggccaactcagggtctgtacaccctgcccacagctcttcatggcctctatgtaagacatcagcaggcagtgccactcgccaacctcatgctggcatgcacacctgggccctcatgtgggatacccacctcgtggctgtgggacgtagggagttttgtaactacagtgatgatgccaaagatgacagggacataaacaggggaaggggtagaggcccagaaccctcagggtgggagctgaggcggggcagatgtgcctttggcaaggctgtcaagggcatgcagggaaactgcaaagccaattcccactccacctaccctgccgctgtcatggggatgtcagaacctgacaccttccctcactgtgacagcctgtgatgagcacccagggcacagctccctcagcacctgcagtcactgcagcctaaacccaggacccttcccctccctgacacctcagtgatatgaaaatacctcccggagtgccctacgcatcctggcggctataggacactcgaggaaaagcagcagggcccccctctccaaaggtcctgggcacctggtggccacccttgtccaacggagccaggccagtacccgagccaggtggtctccaagcttgggccaggggccgctttcccggccagcactgacattcccgtttgatggaacggtccccatggtacctctgaccaacagagaagtgtggtcacaggactcctcaaggactccgggccccccagcaaccatgttcctcacagtggggttggggaggcacggccttgggaccccctgcagtgggtgcacaggtctcactgacaaatccaacacccccatccccaggccttggaagccctcctcggctgtaccccacggcggctggccatgtccacttcactcagtgcagccaccctcaggctgtaatccagcccccacccccagcccggcactggagccttcctggccccaagctgcagcgcccagtccagccctccgtttggcaggtctgttccgggaactcccctgatccacccctgctccggccacctggatcccacacccttccgatccgtcccacacatgttcagatttctgcctggaaacctggaaatgccatgtggtcctgcaggaggctggtgccactctcagggtcaccctctgtatctcatcctgggggtctgctggactcgagtctagttctaggactagaagcccaggtgggggtcccaaggagcatcggcagggccttgcagggcaactgcctcaagggaggccaccccgggccttcagctagaggggctcttccggcaatccgggcagacacaggcgtgtgtggtcccagcttctctggatctgcccatgggccccactccaatattcagggtcatggttctttcccaatcaacacccgcttttaggaggagacgaccggccaggctgggcccggctgcatgcagtgtgaggctctggctgctaagtcctgctcttgctgtgttgtgccctgggggccaccctgtgtgcagccgcagctgtgactgtggccttggccactgtgaggcggtgcttgtcacactcccttgctgctctcgtgccttctgcccagcactcacctggaggtgcaccctgtgcgccttccccactgcaccctctgcgggcaggcgtgccctcccggatcccacatctggcctggccctgtgcgctgcaagccccccttgccgtccctcacaggcacctttctctgcttcactctttagggagttcagttacttcctgatcctgatcctggcctcaacctgtgtgttgggagctcctggcctcctcggggtgaggggtcatgtggacatcgacgcagctatggttggggcctatcatctcctgaggcctggcccaggaaacccacactcggggtggcccattcaacagcaggtgtgagggtggggctgagcatcctgcctggtgggggtctgagggcactgatgctaagtgggggaccagggcctcctcagggagctcccacctcaagcctgcaacttggcaatggaaatttattataaaataccctcagctggcaacacagcaggcccaagccaacgtctcctgcaggcctcggacggccagggctctggctggcccccagagtcaccgtcctgtgatgaggcactccacaaaaggaaataccaacctcatgaagacagcggggactccatggtccttgggccatgacttgctggtcctcagaggcccttgaggtttcaggccaaggctggggcctgatgcccacctccctgcccgccctcctcgtctcccgggaagggagtgggtgagtcatgcgcgtgggtagagtgaccagaggctgatccgctgatccttggagcccgcggccagcaagccatcggcggtgaaggccacgcactggacagcggcgctgtggaaggccagcacggccagtggctgcatcgtccgccagtggaacacgcggatgcggtggtcccagcctgcggtggccaggatcttgcgatctggccggatcgtgacctcggcgatcccgggattggtgagttcatgagtcccacgcacctgtgagagttgggagaggtgttaggccactccttaagcccacaaggcagtgctgcccctggtgccccacctgcagctggaaccaggagagacgcaggcccacaggcccgggatgtgagggccacacgctcctacccagctgacctcccactcttcctaaggccacgatgggggactccagccctcccctcagagtggtcttcggccctgccctgctgctcctcgcaccagctctgaccgactccttccccagtcagagagcagcagagacagggaggtcccagctgcaggagaggggctgggtcccgggacccctcaccccagggaagccactgcaccctagtgcctagcgagaggccacgtcccgggcttgatggcagcagaatgctggcactcctcccagaagaacctcacaaccaccccaaagctgacgagggtgagaaatacaaactccattttcagcaaaaccatgaggtatgtgaacccccaagctcgacagggctgggagcgctgccaagagcaagacccagtggggggttggcaggatgagggggggacaagggggagacgccctggaggcggcaggagccacacagtgtaccttgcctggtgggggcaacgtccccggctgggttctgagagggggtagggcactgcacgagacccggagccacacagacaggtcctacgtgcacggggccgtcggggtgctggcctcttcctgggccgagcgttggggccagggggtggtggcatgtgcctgtaatcccaactactcgggaggaggatcacctgagcccagtggatggaggctgcagtgagctgagatcactgccaccgcactcctgcctgggcgacagagtgagaccctgtctcaaaaaaaaaaaaaaaaaaagatacgctctaataaaattattagacttcatagctaaaaaacctttggtggccagacaaaaagaccatgttgatgagggtgctgtttaggccgtcctcagaatgctccacagccacagggtgccaagggatgacggggtgatgcctgcaaggctgaggaggaaggcgaggtccaagtattttatatccagccaaactgtcgctcaattataaaaacaacagaccaacatttctgaacatgtaagaactcagagaatcctgcacccataagctgttcttgaaagactagaagattaactccagtctcgtaagagataactggagaactgcagcaaatggtctggcagggagcactggacccacttgcctataggatcagctctaagacaatatggggattacggctatggaaccggttattataactcacagaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaacaagagacaagggacactttgtgctgagaaaaaggctctgcaccaagatgaggtgacatctcagcgcctatacacccacactgagccccagagcttcaaagctcatgaagcaaaactggcagagacaaagaaacaggcacgtttgcaatcacagttaaagattttaagagccttctctgcgtaactggtaaaaaaaaaacaaaactagaccaaaagatcggtaaggatattaaagactggaaccacgtccactgacctgggtcaggctgacggaaggctccaccccacaactgcggaacacacgctcctttcaagtccatgtggtgcactccccgagacacgccatgtgctgggccaaaagcaagcctccataaatttctaaacactgcaattgcactgcgtgcattcactgacaacagaattaagctagattaaagatatagctacaaaatcaacgaatatttggaaattaaataacacacccccaccaaggaacctacagatcaaagagaaaatcacaatattctgaactgaattaaaatgaagacacagtaagtcaaagccaatgagactgagtcacatggaaggtggccaggctgggagctgaattctcagcagcccagggaggtggcaggacctagacccatggcccagcagctgctgctgctcagagaacggcccctcagcatccaggcccgtgcatcagaggccaccagcacagccaccaagaggcccctgcctgaggaatccctaaaggatgcgctttttggcttccagaaggaggtcttgagatgtaagaacacccagggcaacgctcacacacgacatgcaatcatcgatgtgagaactggctccataagagatgtgtctacgcctggagggccaggaaggttggaggtaaaatgattaaaatgtaaaggctataaagggaagtagtgaccaaaagaaacctggactgagccatattaatagttggaaaaataggctttggggcaaatgtcctttctagagatgatgagggggaatgaagaaaagacctcattcaccaggaaatcaccattttaaactggcatgttcccaggccagcttcaaagtgcataaagcaaatacagacaggcccccagcaaaagggaacaggacaggcctctctgcgcctgctggggaccatggtgacctgcaggatgacttaaagggctaagaatcagtggacacacgggcctggcgcccacgtgtgcagcggggcatctgacaaccagcactgcctccctggcacatgtgcaatgcttatgaaaactggacggccccgcatttcaaagaactaatatcattcagaccttgttcccagaccacaatgttaattaagttagaaattgaaaactaaaaaataactggggaaaaaaatcaaacattcagaaccataaaaacattctaattaactcagcagccagagaacaaataaaaatggggtctttgtgtcaaatgaggaatatggggaaaaaataataaaaatggggtctgcctggaagtggggggaggaagacaatgtcttcttgcaccagggagcccagctggacagtcacctctggaaacaggctccatgtggggctggcaagggaaggctgagtgccgatgggctgtgcacctgaccccaggcagggcagcagatgcaacccaggggacatgggatggagggagagcatggcaaggacagaaacaatgaacagaaagatagaaatgctcaaggacaaacgcatacaagactgatcaggaataaagcagggacggagctttgaatgcggcagaaatttaaacaatcatcacaagcagtccaaaaaaggtcactaggaatacaaccttcaggatttgtatgcccacagacaaattcctagaaaaattccccaaatcaggaaacctaaattagtccacaaagaaaacaacctgggcagagaaaataactgcccagtaatggtgcaggcgaagaccaacctacagtcactcacgaccccccacctccaccgcccaaatgtgtccatccatcgggagaagagggaacgctccccaccagctccctgagcctggggctcctgtcactaggcaggtggtgggagagggaggcccaggtccgtctgtggccctgggcagttctggcccagcccagcagagtgggcggagcacatgtcacacacgggagggggggtgggggtgcaggcggtgatttcaagacttttccctgagattcagggacagactgaggattttagttgttttaatgtttaagaaaactccaacaatgcaatgaacagattcaagaagaaaacctgtatgagttggagagatgcagtgagatcatttagtgacatcaggcacccattcaagacccagattctttccccaggaggggtgggaggagcctcgcctggcgaggagatgccaccaaacaacccacagctagcgcagccctcaccctggcctgggataccaccgcctgcgcccccaacactgctctaggctcctggccagtgaggtaggcgccttgccatgccctcagccacctcgccgtcctacctcaacaccagcttgtctctcaaggccaagcccctgcaagcccatcatcctgccctttcaaggcctctccagggcccggggccccctggttcacggacttaccaaggcctgcagccctgacccctctcatggcccctcccctcccaccgcgcactgtaaccagcacagtcccagcacatcccagacgctctgcctgtcctctacctctcttgcctggcagaccttggctctgggggtctcggcggtatcctgcctgtgcacacacaagcagctgaatgtgctgcagcacgacacacagccattggttggcaaccgcaagcccaggctggcctcagtgtccagagcacccggccttggcgctgcctcccctccctccacaccagcccctacctccccacttggctccctgtgacccggctgaggggctgtcaaggccagcacctgctgcgcggggccgtcaagtccagcacctgctgcgcagggccgtgaggggatgctggcatgtacctgtcatgcgtgtggggttcgccgcctgtgcttgcagacccaggagcccctccccagctctcagggaccagaacacagtggcccagggaaggaactggcggctgggaagaacaggaggctgatttgatgccatcgtcacccatttctctcctgtgacctctgccctaagtcagtggtagagagggaacaacaggccacacgccatgggcctcactggaagccactggggcctgctcagggccctcttgacaggaatttgctggcaggtccttcccagggagaaaagagctgccaaatgcctggagccacaggcgtgtggggaggtttccgtagaagtcctgaccagggatcttcacctgtggaggctgagatgcccagttcctcctgcccagctcctgcccagcagcctggctgtgcctacccaccagccaggcggccactgcctgcagggacaggagcgaccccacacccacctcagccattctcagaaagcagtgacagcatcaaggtaaagaaaaccaggttcaaggaccagcttcccgcaggaaatgaggatgatgcgggaagcctggtggggcctcctggagaaagactagggcctgctccagccctgtgttcctgaagaagaggaggactggtcctggccctgcagtgacagcagccagggccctgcactaccgtgctcctgatggcagatggaaacatgtccacgccctgcacaagcctctcctcctgatgcgatgcacggggagctgacccggggccctttggcctccctcctggctgcccagcagctctgctactgccctctaaagggaagcctctggcagacagcgcagcagccaccactgctgtgcagatgggagcgcagctgggacacctggccatgtcttgtgggagagccacggttggtccacttcccagaccagggctgcctggggtgggggagcctcattattacttaaagccctaagaatatggctggctgtaaatcagtccccacttcaaggctgtgggcactaccccaaaatgtgggagggagagggcctgcgtaccacctgtatctgatgacaacacaggctctaactgtgacagctcacgggaaagccgcctcagcaaggcaggctcagggctccagtcaccacttgaccccgaggcaccctcaggtggtatcctgatgtgggcagcctcctcgtcaccaccgcggcccctggccaagccccagcctggacctgggccttccaggaaggatctctggccaccagtggctctcgtagcgcatgacctcaggtgccaggaatgcgtggtgcggcgaagccaccatctggttccgattacccatgctctgctccaggaacctcattcgcgtctctactcccagcacccgccggggggagactgatctgggctcatcagaggcttcggcaggagggtgtgagggggacacagccgtgcccacgtggctctcagccaaggagtcacagtgcaggcggtgggtgaggacacctgtgggtgctgaggaccttcggtcaccttgcttgctcccgggtggcaagaacgctctcaggcagctcacctccgaaagcgcccccacaggctttccctgaggctggggctttacagaacctgcaatctccagggcctctaggatcaacgttaagatgtgacattgggcagagggtggcgcatcagcctctccggctccctgtcccctgttcctggagtcgcctgtcccctcccaggcctcctcctggcccatgcaacacagggctcagcaggggaaacgcctctccttcgatgtgcaccatgggccgatgccctgcccagcacgccacagccacgccaaccactccctgttcctggttctcccttctgctctcactttccaattcattaatacctggtcccccttttgctttaacttttcaattcatcaatccggtcaagttcatctctggactggaacatgccccataaattacagtcctaagttccagcagctgtttcccaaacacaccaggagagacgaggcagatctgggccaggacggcaggagggccccttcctggggtcctgggcacagaggtggaaactgcagagaagagccctccgggggctctcagggaagctgtctgggtcttcagcgctttgctgtcaggctggtgaaggacaagccagtgccaagtgaacactggaccccatgggggcagccctgcaggatccctgccaggcttgaggaggagggagggagtgcaagggagacgccccttccagacatgcagacccagcacccagagtggctctgcctcccagcgcccagagcagctcagcttctagctgctcagaacgggcatcatgatgatgacacatccaccgaccacccaggcctgctaagccttaggagacccttcctcccggggagacatgagaagctctgccgcttacatcagggccttgtgcccccatccccaggacagctgacggatgggtgagggatggacacagctctcctgcaagtctaccatgtgcctgcacaggttggtgatgcccacagggcactggggccgctcacagaaccctgcccctctgtgtatcctagtctcaccagggcatgtccttccgcagctccaccatgtgcttcaaagactctggtggtgcccactcaggggtgggcctgacggacccgaggtgaaccctccccgccccacaggggccagggctgggcaagcgtgaggcgcagcaggcttgctggggctgcgggcaagtctgccctgcctggggggcccgaggaatgccctctctgtggcctcctgtcgtacagacagcctggaccacagccctacagagaagggcagccccgggccctgtccttggtgaggctgggagctgttgctgcttctgccagtagtcacctcacgggacatgcagctccccctggaggcccttcacccactagactgggcaatctgaccactcgctggctatgggtctcaggcttccaagacttctggtgaatgggggctccttgtccaccccccagaagccaggatgtacccaggccacacccagcacctcatctcccatggtctctgcagcccctgagacttgcaccagagtgagacctggacaggagactccccttgcccccaccagcctgacctgatccctcccatcccaaacagggccacgtgtaggccaggccaccctggagccacaggcccagacagggacaccacggtgcccctcgagccatgccagctaggagagcccaggagacaccatgggaagatcttcagcaaccgccaggtggccctgaggcttcccagccttcctgctgggctttcctgctgcccgtgagcaatggcctccctcgggccagctccagaccaccacgggggctgcagctcctcgcagttttccacactggttttttttttttttttttgattaatcagttccttactgaccaaattcctctgagttttcacaaaggggtttgagtattcctggactctgcgtgcctttctctagatggacaagatgtgacggcatgaacccgaggtctgggcgaaacccaaaccatgtgaatggtctgccagcgcccacgcccccttcttcctgcgccagccatggacagcccccctgcacccgcctccaagtgattaattagccagggatctgcaacaactcctcttcatgcctaaatattgtttcagcctatcagactgttagtgcagagcaggataaatgagacccggggcctggcgcactgacctgcagggcctgctgccagtccaggctccagacagccagcgccttccccgcggagcctgagatgcccctggccttctgggagtcaaagtcaaggtccatgacgggctcctcatggcaggcgatgcggctgcacaccttctgctcagagacgtcccacaggaccaccgatccatcctcatagccggccagaaggagtgggcgggagctgcagtcggcctgcggggaacagcagagcagtcagctcctggaaggaccctgactccagtgagtttcgggggagaaggggctctggaaattcctgcccctcctgctggctggggctgtttcccatgtcttccacgtggctgccacagctcagaagctctgcaccgccagtgccctcccacacagcccctggatggctgatgctgtcagcatgggactggcacggctgcccttagggcaccccaaggacataggggtggagggcagagagccaagcccaaggcctcccactgctgtaccacttctcaccagccctgcaacctgcatgtgcccaccctgggttctgcccaaaggggtgatgctgggcacccaccagccactgtgagtgctgccgaccctctccacttctcccatgcacagggacctgtcctcctgcctcctttccccaggcctaagatgtgtggccaccacttactggggctggtcacctgtctagagccgccagccagaagaaaccgtgagctccatctccatgaaaaatgaactctctgtgctttgtcaaagtggctgccgaagcccctgcccctgaagcctggcgtgagccgcccgagctcttgtgatgaatgagggcgcgggtcagagggctccaagccctgggcagacacctcgtttgttaagcctctggaataattgcaggaggagagcactgcaggattccgcatcaccctggggacacagccgtcagtccccggcaccaagaatgacagcccagagaaacctggcatggctgagcaaggagacctgagggagccagaaggcaccagggcgtgtgcctaacaaagggatgctgagtcctcagacaccacaaggaccagggctcgctgcatcagaaggctggtgatgggaaccggggtagccaggcccggagcccgaggccaactgccctgacctggaggggatggccatgccagggacagaaggacactcactgtgccctgcaggatgtgggcatgtgaacccgaggccagagctggtccagtggtcctcatacatgtccctgaaaaagacttgtaaaaccactgggttctaataacagagttcacacagacaaaactgagaagagtgaggctccaggaggaggcgagtggcggtcagtgtgtcttctcccggggcacctcctcccaggcctcatcccaagtcatgccccgctgccagagtccacattgtccctgggaggcagggctgccccagggccccgagtgtactcagccccctgcccctccctgcagaagtcctggccacgctcctgcgtgtgctgttttatccctgggaggagttccatgttggcacctttcagatcacctgctgggaaatgaggcgtgcagggacccacagtactttccttcccaacatgggcaccatgccttctgcacagaagctccttgcaggcagccctggctccctagaagggcctccccctggtaagtggtgcgtctgaactcacagtgggtgagggccaggcgagagcagcggggaacactctgcatcccaaccaggaatgcaggccaaccccagaagctgactccaaagactctcctcattggacccactcccctcaggcagcgctctgtggtggcacctgttcccagcctgtgccaccctcctccccggcactttcctccactgcaggagctgagactgcctggggctgctcccatcaccgatgtccttctggcagtctcagagcctagagcctgtgtgaagccactgcctctgaattcagatgccatggccaacgcagggactgtgtgtgtgactgacccgcctgtcgtggtgccacagggtggctggagcagaagccaacctggcctggaggggcttgccctgtggttgccagcccctgctatgcccctggtccctgcagccccctagtgacagataccacaggccgggcagtcctcttgtggctggagcacttcggtgcccacagccttgatgctgcctgacctctgcaggggagaggatctgaagtctcctggacctgttcttctctgccccctccctgcccgcagatgagacctggaggccaggcctcattctgcacccctcccattgactggcacccccagagggacacagcaggtcaggggctgtgggaagccctccatgcaccataccccaagaagcagggcagggctggctggagtggcccctgccctgagggctatgccagtgactgcctcaggcttgacgtaggtcctgaccttttatatattaatagcaattattcttatgttgcaggtcagctgcttagaggagcaaaataagaatatactaaaaattaaaaattaaaaaattttttaaataaataaaaatgtgattgccccccaaaaaaagaaaaccctcaatgtttcagaaaaaaaaaaagcaagtcaggccactgtgccacaattggattgataaattataacctgaccctcaggcttggggatggaaaagggaacatgtggagttaatgtcggcttttcttagcggaatgcttcacgctggatctccatcaccaacagaaacacgatttgtcctctgtcaactacattaattaccttaacaagtttgtacatccctttctacgcatttttctgttggaattttacatgattgtgcaatgacccacgtttcccaaggggtggaacaggagccgtgcagactcggacacccttccccaggacctggatgccctgcccactgcctgcggggttgcagccttggggggcgtttttcctcccagcggagcccatgtcaagcccttggaggagccttgtgtgggcacatggagcccagtgacccaggctctgctgcagtccctgtggcccggctgtgagcctgctggcaccgagtttcatcatctcaggtgagcctcccggaagccaccctgcctcctgtgagggcttctccccaaatggccacagccacagaagcagcactacaggatcagtccacgggagaccccaaattccaagtgaaccttctcagtcaagaaaccacagggggaagctgactgcagtaaggggcgcccactttctggtcacgtggagagagagaaaagctgggggcagggactctgggggtacccatcccggtgggccttgcagggcatgcagatgcccacaaactgcacaggcccatccggtctcgctctcatgaggaggtcaaagaggcagcgagccagagtcacctcccggtaaaggcccagcccagggcagttctcagagccaaacagaaaaggagggtgcctgggccgggcgcggtggctcacgcctgtaatcccagcactttgggaggccgaagcgggcggatcacgaggtcaggagatggagaccatcctggctgagatggtgaaaccccggctctactaaaaatacaaaaaattagccgggcgtggtggcgggcgcctgtagtcccagctactcaggaggctgaggcaggagaatggcgtgaacccaggaagcggagcttgcagtgagcagagatcgcgccactgcactccagcctgggtgacagagcgagactccatcacaaaaaaaaaataaataaataaaatagaaaaggagggtgcctggcatgacttagggcctgggaagagtgctgctggtgaccccttaccgtgggcttccgaggcagctcagggctgaggggctctttgcaagtgaatgcacgggatcacttgctctgcagccctggacatgagcggccccgaggagggcagctacaccttgagccagtgctggcctgaagggtgatgagggaggagactggcctcgaggaagctgtgctgcatggaggcagctggcccagaagagtccctcccagcaaccccgacctgtgccccggctgatgccttccaaccctgtctaaccacaaagaacagttgagaaggaaggaaatgttcatggatcagaaattccaaatgtggcctcagggaatgtcattgtgttaagtccactcctgcctctaagaggcaaagaagtaataaaaatcaatcctaagcaaagcgggggccgtgcaggcttgctgcagttagtcagcgtggcctgccctgccctaagcacggcccaagtactgaggcgctggcagaccccactgtcccctcctcaccgctcactggagggcaccacgagctgcggggtgagcccaccggagcttgcaaaggacgaggacctgctgccactgctgctggctgaagccaggcctctcctggggcactgacaggaggccccttgcagcagcaggaagcagagggccgtggggacactgaggcagctgcacaggttccctgcggcaggggggtggggtgttgcctgagtggctcgacgataaatcagatcctgaatggagcatgactcatggccgtgggtgtggccggcagggcgtggctggtgcacgcggggccttacctgccacagccgcaggcacatgggcatgcccagcttggcatctgccttcggcttcagggcgcacactgacgtcttggagggcatctccagaatctgaacctgacagtaagaaaacaagttgatttgggccgtcgccaagtcgagtctgcgctatacaaacaagagactcttaaggcgattagcccgggctgctgtgagtttctgtctgctcccctccccgtgggcacctgggagcccaggctcctaattaggctgcatgggcccttgcaaaacgctctcactgttcccaggtcaccgcctggcagctgccccagcctctcccgacgttaccgtgcaggctgagcaggaggctggttcactggcccctgacagagcccaccgattctctctccttcctggtgtaggctttacatacgaaccagtgtgagtgatctcaggcatagccatggttctaagactcgcccaggagcacctagggatttgccacccacttgagaaatgaatgtgatgtgcgtcctctgagggcagctccgggaaacctggctcccccacctggacgccccggtgtcccctgtgcatcgaggctgcattccaggtcccctgaacacaggccagggcccccctacacctgggctgggagatgtgccatgccggcttgtggggtgtaggctcgctggtcacacatctcctgaacagccaggtcaggggatggccgaggccacaagcagcagactgccaggtggttctgctggaatccaggtccgcctgcaccctctgccctcgctctgggaactggggaggctcagccagcactgaacttccccaggtacaagcgagagcagctcactggcccctgacagagcccactgattctatctcctctgtctgcttctccttcctggtgcatgttttacataggaaccacttggaatgagctaccgataacacagcaataatatcaatgcacagccaccttggacagagcctggcatacatggggcatcacccactttacacacaaggagtccaagcccctgaggctgggggctctgagtaggcagaactcataccagttggtccagcggtctctggcccctctattctcctgagccaggcagagggatcgtgtcttaggggcctgtgcctctgtgggtgagaagcttgctgccctcactaacccacacagaataggcccgggaccccaagtctgaatcccagatctgccacaggcatgctatgggtgtgctgaggtcacctccgggcagggcagagagctgggcccacagcccggtccttccagctacagagacctgctgaggcgcccacctccagtacgcggaccagggccacggcgcttcttgtgcaggctgctcttgccaggggcccccacagcagctcagcctctgccagcagggcttctgctccactcagcaccaggagcttagcctctgacagcagggcttctgctccactcagcaccaggagctcagcctccaacacagggcttcagccccactcagccccagggatggctcacagatctaggccccacacaaacgcatgcacacacacatgcatgggtaacatgtacacacctgcacacacaaatagagcctcctgcccatcaagcccagaaaccaggggcctcagggggagccaaccatctgacgaaaggggcccccggggaacaaacagagcaacataatgaagagggcaaaaaagaactcagtaatgggagaggtgattacagtcaggaaccaagaggctcagtgatggtgagaccaggcctgcgagctctggggaaggttgtcaagcctgaactccaaagccggccaaaatggtaagcaggagggtaaaacagaggtctctgtggacaccaaggattccttgcggaaaaaccgctcaaggagaagctctagccacatggaaatataggaacattgatgtccaaaaaccaagacgaggtgccactgagcctggcacagaagaacgtggagaacccaggagaagctggggcgggcttagccgttctttgtcttctgcaagtaacagcaactccgggacagggttcctcctcttaggatcagcatggccactgagtgaagagctagaggcaccagggcggcctgcaaggaccagagttatagcccatgtgccacctctgtgatcccagctaagggagcagtggcaagctgtcattgggtgttgccaccattgtccctttgctgttttcaggaagggtctgtgagagccaccgtcagggctgtggggagggtctgggagggtgtagaccacactgcctggctcactccccacatttccaaatgatacgggagaggggcagggaagtgctaggaagggaagtcacctggcaagggctccacccccgggcctgtccctatagacctaggtgaggacaggcactcctgccttcgcacccaaatgctgcatttcccaagaccaccctggctcaccacacccccattctgtgcctttaaaaacccccaagaccatagcaagcagagacacaagtggctggacgttgagaggacgttgaggggagcacggtggtggaagagcacaccgacagaggctggcatgctggcaggccatcaaccagcgagcggaatgaggtggaatctggccgggcagttggaggagagcccaggccacccagcagcccaactccaggggaaaaccatctcccttctggctccctcatctgctgagagctacttccactcaataaaaccttgcactcattctccaagcccatgtgtgatccaattcttccagtacaccaaggcaagaaccccaggatactgaaagccttctgtccttgcaataaggcaagggtctaattgagctgactaatacaagccacctatggacagctaaactaaaagagcaccctgtaacacacactcactggggcttcagctgtaaacattcacccctagacactgctgtggggtcaaagcctcacagcctgcctgtctgtatgctcccctagaagtttgagcagtgggacaccgaggaagcgaaacacacctccattgcacgccccgggaggggataagggaacttttcccatttcacaacctgttttccccatattaaattgagaagttttgttttgttttaaagtcagagtctcactctgtcacccaggctggtgccatcacagctcactgcagccttgaactcctgagctcaagtaaccctcccacctcagcctccccagtagctgggactacaggtgtgcggccaccaggcccagctaactttttgcagagatggagtctcactgtgttgcccaggctggtctcgaactcctgggttcctcctgctttggcctcctgagtagctgggactatgatttcctactttttgcactcctctgtgccagatttcttaaaataagatctgttcttcttgtcgctatatcaggaagatgggctagttccagcagttaatggggtggggaggtaggggacttaagccaggggcaggaggagccgccctgagcacacctgtgcctctgtggggtggggagggctgcggaggaggcaggcactggctacacagcctacacggccatacacagtccccaaccaaggaaggcctgtctcaatttgggctccaaaagacccctctggggacagtgaggggacatcaagggcaaaggacttgagcaggccagtgagggcaggggcaaaagatggggggaggaggggtgcggtgagggcagaacccagggcagccctgatgccccactctgggcgctgcaggagggagcgggggtggcggcgccttgaaccacatcctgggtgcaggggagtggtgagccctgggcctgagcaccagaggtacacaccacgtctacctgggctgggtcctcagcccggggctgcccctgcctgcgcctgtacttggagcctcctacagacacccatgagctttccgcctggcacctgactgcaacttttgtttccagaaggaaaaatgttaggtttgggcaagtgtggccacccagccggccgagtggggtgggagtgcggctccctgggcgttgtctgggtgcaggccagtgaggctttctcccgcccagtctgacagattccaggtgggaatgtggaaagcaactgttttcccaggatgtgagaggtccccagacaggctgccccgggaaaagacagatgctgccccacagggagagctgaaagctaggaggagggttagacagccttgagcacaggggacgtgtggcagggggcagcgcaggctgaccgagtgctggctggcggcctgggggtggccgagaccagcgcatggagcacagcaggccaagggaagagctgactcaaactcctgcagcattcctgtgggtctgtagaccttgggtcccgggggaggaagcacgcccctctttctcacataaatacaacttgtaacaggtttttggcagattggcaagaaaagtgtatgtagctcctaattggttatttaaatgcaatgaacaaataaatgcctgttcctatctcattatttctgtactggatctgcctgaagacagaacgactctccttgggcaggggccaagcccaactgtgcgtgggggccgtcctgcccagtaccagccccaaagactgcccgggcacagcgaatggggaggactcggcagtgggcatggacagtagcccccacgtgtgcgccccctattccatggtatgtcctccccatgccccgccctcgggccaccatgccccactcaccaggtgggacagtcgccactcaaaggctcttctctgatttcccttcagctcccccaagagctgagcctccagccacaccctcctccactatgacaccctccccgcacatcttgggcacccctcccttggcagaccctgcctcctgtgccactgggggtgtggataccactgtccagctgggccagtcctgtgttaccaacacctctggtcattctggcctaagctccacctaacagtggcctccctgcttggtgatccccccaccccctgggtgttccctagctcacctttcccctgaggactgtgatcaccaccttgtgcctgcacccacccatcccagccctggttgtgtgccctgagataccaccctccctgctgccctgggtcagccctccccaggcctccaacttcaccagggacttggtctctctcccaccgcctcctgccagctgccccggagcgttcctcccacttgggtctaaggtcctcagggcctgagcagtctctcccctgccgttcctgccggcctcgggcctccatgcttggccatcccacgccactgtcctccatgtgcagaactatgctgggtgcccaggcctccaaaacaccggcccctcccccaacgcctcctgattctcccactgccctgggaggatggctcatcagcaaggccaccccaaggggacaggcccaggcctagccggctgtgcatcagccccggctgctgaagctgccggcaggtgggcggctccatggagtcctgtgggtaggcgcaggcgcctcctaatcaaatgcagaggatgagcacaactgtttggagaacatggggcctcaggcaggctggctctcacctcgtcgctgcccctccctggcacggcaagcgtccagcgtggctggcccccggccaggatgctgctccggcagaagcccacactctccaagcacacggagtccacgacagcgctcctgccctccgcgaggtcccacaggcacagcttcaggtcccggccctgactgccagacaaagaggagacaggcctgagactccccttgacaagtgtcagctcccatggcccctgcagcggaaggaaggcaaggccatgtttccagagagtgggtgccgtgagcttggatcatcgcaggtcgggagcctcagctgaggaagggcctcaccgctctggcattgacacttgagccagcaccaaagtgcccgaggccaggacatgcagtggatcaaggctgtggactgatggctgtccagcgtggccccggggtgggggacaccaaccctgcagtgctgcacagcacagagagcaaacttcactgtgtgcaccctaaaaccagcaaactcccagggtgccaggatcccaggaaggactgcagactgtgacaagggggagaacagaggggagccaacctgaggcattttggggtagtgctcatgactagatgcttatgaggttaaagacaaaaataactgtgcagaaactgttccagtgggtgaattagtttctcagaggggtgcaggttacagttctgaatcctctccacgcgtacacctggtagaacagatgaggaaaccagtggtggctcatgggcccggggtctcaccacagggagatgtgacgaagaggcacaggggagacatgggctggcggagtcgaattagaattgtaaagtcaatatgaacaacgagtgtttgggcagatgcacagacagaaatgagtacagacgggtgtgtaagcacaggtcagcgggcacccaggcgtctcccggtgctgtccactgagaacacctagaagcaatgaccacacctaacccaagtcttggtttcttatgctgttctccaaaaacaggaaccagggctctggagaaatggctgagtctagggtggagtggaggaaaaccaagaggagtctcaagcatcctgtagtgccaggcagtgagaaatgcttcaaaaataaaataaggctgggtgcagtggctcaacgcctgtactcagcactgtgggaggccgaggcaggtggataacctgagaggtcaggagttcaagaccagcctggccaacatggtgaaaccccgtctctactaaaaacacaaaaaaatcagctgggtgtggtggcacgtgcctgtaatcccagctacttgggaggctgaggcatgagaattgtttgaacccgggaggcagaggttgtggtgagccaagattgcaccactgcactccagcctgggtgacaaagcaagactctgtctcaataaataaataaaaataaaataaagactgggtgcggtggctcacacctataatcccagcactttgggaggccaaggcaggaggattgcttgagcccaggaattccagatcagcctgggcaaaatagtgagacccctgtttctacaaaagacacaaaaattggccaggcatggtggtgcgtgcctgtagtcccggctactcaggaggcttaggtgggaggattgcttgagcctgggaggtggaagctgcagtgagccatgatcgagtgactgtgctccaggagaccctgtctcaaaaaataaaataaaaataaaaaaggatcggggatgtcagaaggacacggactctgaagctggaacaatctgagaaatcaaataaatcatggtggtattagattttagcccaaagaaagaagtaaatctgcatgagcccatcctcatgagtgaatgtgtattatgtatcagaaagaaggaataaaccttccttccagcttcctatattccaattaaagtagaaatctgccatggctgggagggatgagggaaacgagaataccccagtaataacaggtgcaggcagagtccacagatggatgctaaaatcagcggcaaaagggtaagggtctcaacatgttgcccaggctggtctcaaactcctcggcttaaacgatcctcccgtctcggcctcctgagtagctgtgactacactccccagatgttagtaattactgcagtggttttaacacagggccacacatccttggctctcctctccccaggaggtgaagcttccttttctctttgcatgtggactgcagctagtaagcaaaagctataccttgacagtggagtcaggcagacacttcctgccccagtgaccagggttgtccccggcaagccatgggccatcagggacccatgtgttcagcatggactccgggatgacaggatgagaaacctcacttctgtgggtttcttcccaaaacccatcaccccagtcttaacctgagaaaatatcagacaaacccaacctgaggggcgttctacaaaacatctgggcggtaactcttcaaaagtgtcagctaggtgcagtggatcatacctagaaggtggaggtgggaggactgctcgagcccaggagttcaagaccagtctgggtaacatagtgagactccatctctacaaaaaatgttttttaaattagtcaagcttggtggcgtgcacctgcagttccagctactcagggggctgaggtaggagaattgcttgagcctgggagattgaggctgctgtgagctgtgatcacaccactgcactccagccttggtgacaaagcaagaccctgcctcaaaaaaaaaaaaaagaccaaaatgttgaggtcacgaaaataagtgatcacacaccaaaagggactaaggagacgtgacagctcagaggatcccggagcagaaatgtcactggtggacaaacagaagaaattgaaacaaagtctgggtgccagttattatcatgcaccatgctctgccaggagggccgtgcggtgtgcggtgtgcagttgcggttgtggtgcccacgccacagagaattcagcaccacaaaggccgatctgggcaactcggtcccgtccaaatctccactggggttttggagaacctgccaaactgatgtcaaaatgtacctggacatttggagcacaaagacgtgcacagcccccgtggctctgctaggcggcaaggctcaacatgacactgcagggaggccgagatgggggtgtcctcagcatggggaggggccagggccaagggaggggaggtgtggctgcacaccacgctcatatggagggcacccatgtaagccctgcggggagtggaggactgacttgtttttccaggaactttaacattttttttctttgagacaatatcttgatttgttgcccagggtggagtgcagtggggtgatcacagctcactgcagcctcaaactcctccctcagatgatcctcccacttcagcctcccaagtagctgggactaccagcatgtgccaccacacccagctaatttttgtattttttgtagagacgagatttcaccatgtttcccaggttggtctcgaactctgggcccaagcacacctcagcctccctaagtgctgggattacaggagtgagccactgtgcccagcttaactttttattttgaatcagttttgaactcacaggacagttgtgagaacggcacgaagaccccgtatgcctcctgctgcagtggcctgcttctcccggcccctcctagccctgtgcacacaggtgagcctctcaccaagaactccaccttgtcaacaccgcatcctgaccaagggtgagccccgacagcccacagccatcctggggcgtcgtggcctgtgtggggcctcgcggggccccggctgcctctgccccctgcatggccccttctctctccctgtctctgcctctctctcatgtctttgcactccttccttccctggggacgaggcccaggcccatattcctcagatgacaccagtcgtcacgctgcgaggcacacgatgtgacctgcccaccatcaggggtgtcaaccctgatcgcctggtcaggacccatagttttcaaaggctcatcatccctaattctgatcatttattttagtgctcaaattggcccaggctaatgggagtccctgcaggctggctcagaatcctctgacgtggccatctgcgagatgtccagacctagaatctgccatctcccggggaaccctcactcagcttaggacacacaggcatttagaagccaggacctgggtgtccacctgctcactgccagagtgtgccccagccaccaggcccctccgcacacgggctagggaacacacacatgcctcacatgcatgcacacaacacacaatcacacacaccacacacctcatacacacctcacatacatacacaccacacaggcacctcacacatacacaacttacatacacaaacctcacacacacaacacacaggttctttctcaccttcccccttctcgtgtctgtaactctcctctctgggcagggacaaccctggcctctgttatcctggagatgttcactgacatgcccaacaagcgagcctgccacctgccctcaccaacctcctggcctcccaggctgccgctgccacaccacccccccaaccctgcttctttgactgcctggcacccccttcccaccccatccaaggggcactgaggtgggggaaggcgggaccgctgggtacccacatggaaacccagggccttcactgcacaccgtagtgaattccagctgaaccatggatctacaagggacaacagtaaagttcctgggagacatggagagaggtctctcggacctcggtgcaggaactcccggcaagacacaaaggcactctccataaggggaaagcctggcagacttgaatcaactccattaaaatgagtaactttgttcattaaagacaccattaggggccaggcacagtggctcatgcctgtaatcccagcactttgggacgccaaggtgggcagattatgaagtcaggagatcatcctggccaacatggtgaaaccccatctctagtaaaaatacaaaaattggctggacgtaacggcacatgcctcttatcccagctactcgggaggctgaggcaggagaatcacttgaaccagggagtcggaggttgcagtgagccaagatcatgccactgcactccagcctggcaacagagcaagactttgtctcaaaaaaagaaaaaaaaacgtaagaaaaagaaaacagcgacagctgactgcagctacatgcaacacacggagctcacggagataaagttgagtgagagaagtcacacacagatgctgctccttatgtctccacgcttccaaagaaaaaagcagacaaaatagtctatgcttttcagagacatacattcataaatatagcaaaaatgaggcgtgaggggctacctcctggggcatgaggggctatctccagggagagcaggtggcagcagctcagggattcagaggctcgggggccctgcgctctacttcttgactggaaggtggttgctcaggtgctcactcagccgtaatacaatgctctgaacacttgtcttgcactcttctgtgagtacattatacttcacaagaaaaaagattaaaaaacaccctgccgaggtggctgtcgaaggcacaggtgtgtccttggcatgcgggaggctgagggcgtcctcccacctcccatcaacatgaaagccatcacttccttcaagggccacttggagagacttggcttccaaacacagctgagcacaggccgggtggcggcccacaggctctagtacagtgcagacgcacctggcactccacacctgcagtttctgtccacagaccccctgacccgtggctggctctgcctgggaagcagccactacagcaccatcccagcaggaaggggaggtgccctcgaacgtcagctcccagaccgcccaccaggcctggcacagctcctgtctgcaggacagcctgataccacaaggcacctacgcaagggaccaccaagggctacattgtggctgaaaactcaggaggacacttacaaacagcagctcctgatgcacatggcctggtggggttctagaaatgaagtctactctgacaatcaaagaccaaacccactctgaggccccctgcaccagtggtgagggatctgggtcggcttggccaggatgcaggcatgaccacacggggctctgcaagcacacaggctcagggcctctgctcttcaggacaaccctggtgccttcgtcacctgcagccatctcccaggtggtaggcaccgcgtgagtctagcacagacatgttttgcagactggtgggggccagacaggcctcattctccagggactatactccacagtgccatgaaccaggcaccgagtccagagcaggagaacaggcctgtccttctggagttctgggctgtgatggtgatggcacggagttccctgaatatgacgcaaggcaaatcccaggacagcagcaggcccgtgctcaggattcctgggctggtggcagcgatccccacacaggggcagatgtcactctgatcaaggacaatagcctgctccagcatccaggcagcccaaaggaggacttgttgtcagccccctgcaggccttccctgtcccaccatgccctgtccctcccactccccatgggaaacagagaagcccctcacgcacctgcccctgtctgctgcttcctggcctacctccggcctggtgtctcagccccatcacctccacaagaccacgggggcgatgtcagaacccagccctgggctaaccctcgggggctgcccctccctgctctgctgccagctgcccagcacccagccccactgtccttcaccacactcagaggcaggccctccagggccgcagcacgtggggtctcccccaccaggactgccaggccctcttattcctccgccacctcctgcttacccagcagctgcaccagcgtgtgaagcagggccctgtgagctgggtaacctcaggatgaggctctgccacccatgcaggaggatggtgcgacagccacaggaggccaagttgtagaggggctgtggtgactgggacctgggcccatgggatagaggcagaagctcatctgaggaggggcctgggctcaatgcggacccctggccagggcgagctctgctgaaggcacaggctgacactgcaatggggacacagccatcgccatacgttcactaggctcttcccagcaggcacctggccagacagcacagcagtcacggagggtagggtcacactgtctcgggatgggctaaggcctcatgaaccatgggggcacccagaaacctgcccttgtgctaagcacaggctagaacagtggggtctgaataccaatggggacaggccacctctgtggacccttcctgctggggtacagtctggacaagtaatccccaagtgatgcgtagggtacagaacacacacgtgagctcggggccctgagggaggagactgcaggggtagaaaccacaggagacactgcaggggggaccaggtggggagatggccctcactaccacgcccacttcagaaacgcagaagcacactgctgtgggacagcactatacacccaagccctgcgccccgcccctggccactcagccaccatcttgccagccacatagccgtatgtggcacaacatcaggggctgggtcctcttgggaagagtcaggtgcattgtcataacctagtgaagggacacacacggccagggctcagctgccggaacacccagctcctagggcctccaccggcaccgtgtgtgacctgccatgctcatggcacacggcccaggcaggatgggcagtgggcagggaggccctccttgggaccactgcctgcatccctgagcctgtacttcatcccattcccctcctctcagcaaatgccctcacccctgcccagtttcccaagccacgacccagtgcccttgtgaaggccctcccaccaacttgcgcctgggctcacctcagatgtcaccagccctggagctctggcctcctcacctggcacctcctggctccagcttggagcatgaagggtccagtggagatggtggagatgcagaggcagacctgcctgcctccctgtgacaaggggctggacctgcacaccctgcccttgctgcggaccctttgctggccccttctggttcccccaccccattctgcccctcagtgggggacaccagagcctccatcagagagttcctgactcccccgaaggccatacctggctcctgcaccttggagacccacctgaggagctggcgcccctggggcagcgtctgcagccaggtcacacactggccgccgtggccatccagggtggtaaccgctctccgcgtctgcaggctccagatgtgtaccaggccactctgagacctgtttcagacaagccgagcagggtgtcagggggcagaagggtgtgctgaatgctctggggccagcctggaggccacattgtgggatgcgggcatctaggctggttgagctgaaaagccaacagctctaaatatgaactaagggccaaactggcaaagcactccttgctcctcttccagagaggggaccgggggaccctcaggagcctctaggggtaactcaggcagatctgcttctctggaggtagggggagccatgccacagtaatgcacgctgggtggtcgtgcctgctcctgcgtctgtaacaaagagtgtgtgtgtgtgtccctgcctcccccaagggacagtgtgtctgctggtgggtgctgaaagctcagcaagcctgggtggcgagcagtccatgccccttggccagcaccctcaaacaagcgctgggctccttgctagctcacgacctcctgacttggccctgggtggcctggggctggggccacagctactcaccctgagaagaggagcgggcgcccctgagcctgggctccttcgcagaagtgcagcgcatgcaccggtgactgggtgcctcggaggacaaactgggggtctggaggtggcggcgggcagggggccgtcatgctgggcaggatgcagttacctgggcaccaagggagggcgtgtgagtgactgcgtccctattctcaccctctaggaaggctgctcaggcacaggggtgcttgagatgttgcccctgctcattgtctctggccctgtgcccctcctgggagagaggtgccactgctccccagacactgatgaacggcctgtggctacagaggcaccagttccctgcacggcggtgagcccagcagagagcacagagctcacccttcccccactgctgggggaactgggagccccatggatgccagccctcctcgcaccgtgcctgttggcctctgcacctgactggtgcacccgcttgggccccacctgagccatccctgagtgggcacagcggcatccaacacttcctcggccactctggcctccagggcttcctgtccaccactggctgtgccctctggctccccagatcccaggggccacaccagtgctttcccactctggccatctgcatgccgggactgccggtcctgccactgggcttggctgagtcccgccctctgtccagggctcactccagtgtctctcttgggagccaccctccctccctgctggcaaatccagtctcccttcttctctcctccctgctgccacctctgcccatggccagctcagggatcaggggaaaagaggcacacagggtcccggggggctgctaggaggagccttcctctcacatctgctgggccccaggcctgccccgccacaatttctaaccgctatcaccaccctataaggcggcagcacccttttcactcttggggaaaccgaggcagagaatagtcactgagctgcaccaggcccctggcgctgaggcctgaagtactctagggcctcatggcaccactgaagggcagagtggctggggcagagtcgccgtgcggctccttaggagagctgcggtcacagatgagcagctgttccccagaccactgggcctgtgggggaagactgccgggccaccacccacccagagaggcttcccgggtccgtgccgagcccttccaaccactcagacccacagggcctcgcactccacctcagccccacagctggctgctctgtggggtggccctggagccagaagcgaccagctccatgtctgtctgcctgcagaccctgagctgggctaagggctcagagggaaaggccaggagcagaccactgggtggctggggcagcctgtcacagggggcctttcccactgggctctgggacagtggggcaggccccggcccagccacctgcagcctgcacacaaggcagggaggatggcccacggcagccacagccagcagagggactggggccagtaaaggaccagggcaggggagatgggaaggactcttcagaaggggctgggtggtaggcggatgggggtgcaggttcagaggcaggagtgctgtggatgtctggaggcagctgtccagggtgccccttcagcagcactgccaccgccaagccctgcctctccccttctgaatacacgccagccctctccttactctattcagagctggggcaaaggttcaaaacacctgagaaatgcccctgccaaggtgtcctgcagagtggagggtggacagcagccagtgcccaagcgggcggcatgggggagggcaggaggcctgggaggggccgggcagtgactccagggcgcaggtccaccctgcctggcgagagacctcgggcagccactctacctcccaaccctgcctctctcaaggggttccgaagacaatgcggagttccctgggatatcctttactaactgccaagtcccatttttccttttcttttttgagggggatgagagaggtttcgtcctctctcacctttggctgaaagccaactgatcatgcccaaacttaagggtggcttccaggggaggcagagggaccagaccccacactgctcccaagacccacggcccctgctccagcctgtgatggggaagactccaagactcctgaagacgcagccaggccgggggctggaacagctgccctcagcgggctggcttggaggacagttctcagaagccactgcctgtttgtgctatgcctgccaggtaagaaaggcaagctagccagggggacaggaaggcagggcccagctccaagaggagccaaagaatgcagacccggcaaaagcacctccacctagcaggaaagcaccgagtccaggatggagggtccctcccatgactccagtccaggaagcagagcctgacaggtcacctctacacaggctcccctgtgcagtccaggcacgaacacacattagacacacgctatgctcacacatacacacacatgcacatggtgcacacagacacatgcaaaacccacacataggacacatgcctacacatacatgttcacacacccatatgtgcacacacacacatgcacacacacaggcacacactcatacctacatacacatacacacacgcagactcagacactcaggcacaggcactcacgtatgtgcacacacagcacagagaagcacacacacagacagcacggcggccttgggcggtgccagccgaagcccggcccccacatgccacctgcctggggcctggcgggagtttccagaacctcaccagcagaaggctcattctcaggtgatgaaatcaagttctcctctattgtttccccagaactgcagggaacaaacccgtcacgttgttacaacaaccaaaatgcacaggccaaaatgatgcatcggcaattaagggctccatcatttcaagtaattaaaataaatgctttatttgaaaactaattaattctagctacatatttttcccatgacaatatcctaggattgcttgatttatgacatctaattattctttattaatctaattgagaatcatcacattcccctatcttgcctggccccaggctgtggagcaaaggccgcccttgcgcaaggcccgtgtgcgcccagctgtccttgcggtggccccggcccagccccggccctgtcctcccggaggcaaaggaacaggaaacttaatccacagagcacaactttggcttctgcctgctcttccaggtgtcaaagtgagccacattctttgaaaaatgaaaggcagtctgacacaatttgtgcaactctaacagcccttccagagaagccacaaacacccctgaaagccccagggaacaaatggacgacaacagcatctgcctgcaatgcaccaccgcggaggcagctcggcaggccccagggctctcccaagaggggtccagagcgctcctctgggtgtggggaccagcgggtaggtgcaactggcagagaggtccacagacaccccactcaagggaggcaggggcaggcctgcaaatgtcctgctggcgcaaacccacccacacctgcagggccttcctccctacagatgaagcagggctgcggcagtggctggagcccaaacaccacaggtccctacccaagacattcttgggctcctgggggttcatgccagacaggcctcagctcagcctgggcccccgccctgccctcgggctgcacagccctgtgctcagtcccctagcccttttgtggaaatcagcaaagagtaccacgaagtgagccaacgtggggagccaccacccagagaggccactggcaccacccctgcccaccccagcccaccaggtcctccctgtcccattgggcatgtgacagcacaaggacaggccgcacaggccgctgggagtgcctcaaacaggaccctctgccccactgcatatctcacacaagggcatggaactagctccagcatcccccgaggaagctccagcccataatcagcaagactgaagactaggtcagcacccctttacaccaggacggacaccctgggtggccctctcccaaaaaacaactaaagatgttgataaaagtttcttagaaggccaggcatggtggctcatgcctataatctcagcactttgggaggccgaggtgggaggattgcttgagcccaggagttcaagaccagcctgggcaacatagggagaccttgcctttacaaaaaataaaaataaattagccaggtgtggtggtgtatgcctgtggtcccagctactcaggaggctgaggtgggaggatagcttgagcccaggaggtcaaggctgcagtgagccatgatcgcgccactgcactccagcctgggggacagagcaagaccgcatctcaaataaattaaataaaataaataactatctttaaaaaatttttttaaacacagccaggcacagtggctcaggcctgtaatccctgcactttgggaggccaaggcaggaggattgctggagtccagaagttcaagaccagccagggcaacatagtcagacccccatctctacaaaaaaaataaataaattagctgggcatggtggtgggtgcctgtaagtccagctactcaggaggctgaggtgggagaatcatttgagcccaagagttccaggctacagtgagccacaatcacaccacggcactccagcctggacagcagaacaagaccctgtctctgaaaaaaatcaaaatcaaaatcaaaatattaaacgcatcactaagttgacaaaaaaaagtctgagctgccagaggccaaacactaagtaaaagtgcagcctcgggagacctgccaagcctgccttgagggcatttgctgcactagtgacctggatttccagctctgatggcctctggggtgacaaaaggcaaagcttagggccatcctatggtggctaacctcctaggagaaccccagtagctagatgctcagtgttaggctgagccagcactaaacctacacccacggatgccagaaaaacaccagtcctcaggtttcagccctaactcacaccaccttgagagatcccccacacttcagtctgtcttctcagaaggaacccacctgcaacccaggcctcaaggaattcactttagaataagtcctaagaagtgcaaggttgtagtcaaaaatcacaaaagtcaacaaggcactgtaatcgagagtcatgagaggcaacaaaaaacagaactagacccacagagcagagcactcgggtatataaggcaagggtgcttaacgctcttaaagaaacagagagggaactgcaactacaagtagagagcaagggagatgaaacatcatcacacagatccaaaaaaggatccaacttggtgagaggtggttgggaaacaggagatgtgtgttgcgccaaggtattactctccaaactgtttactgatcacaaaaggaaaatgtgtatcttcaatggagacatctggctgtcaccactttcaccactgagaaaagctagcactgccaataatgaacaaactggcattgcttatctcctgatgtgatgccacagacatggcaccaaccttgtgtgtccctgccaacaatgctcaacctcaatccagccataaaggaaacaatcagacacatccaggttacgagacactgggcaagactactagcttggactcatcaaaaaggtcagcatcaagagaaacaaccaaaggaaaacgctgggtaacttccacattaagagaccaaaggggcatgatgaccaaacatgacatataaaccttagatcctggctcttagatcagatcctggatcaaaaaaaagggggctataagggacatctgggggatctttgtgggtaatctgaatatggactacagataatggggtgttattaatttccttggaaggataacagtattttatgtagaagaatgtctttattcctacgagatacatccgaaagtatttaggggtgaaatgctataatgtctacaatctgctttcaaatgtttcaaaaaaaattctctcttaatctctacctatctatgtatgaatatataggcagagaagtagtacaaatgtggcaaaatgctaacaactggtgaccacaggtgaaggtgtacaggtatttattttactacacttgcagcttttctgtagatttaaaaccataaaagcatgccagaggggtggagaaagacaagtccacactggactcgtatccagaatatctaaagaacacagaggtcaacagaatacaaaagcaaacaccgaaagaaaaataagcaaaaggcttggacagatatttcacaagcaacgtaaatgtccaataaatatatgcaaagatgtttaacctaattaataatcctgggaatgcctgtcaaaactacaatgtgatataattacactctcagcagattagcaaaaaattaaacagtctgtcaaatgttgatgaagacagaggacaactggaaccttctaccatgctagaaggagcgcacacggaaacgaccactttggaaaacaatctgactccatcttgcacaccgtatgactcggcaaccctactcttagataaacaccctgaagaaattctcacaagtgtgtacaaagaaactcacacaagaatgttcctagtagtattgggtataataacaaaaaccaaaaacaacccaaatggctagcaactgcagaaaggaacacattgggtaaattcgtacgatagaatactccacagaactgaaaatgaatcaactccagtcttacatggatgaagctcaaagtcataattctcatcaagagacatgaagggagtcaaaactgaagacacagacagaaataaaatgttcacaacacgtatctgttcaaggattcattctcagaatttactccttgactcagaatatgtcactcaataagaaaaagagtgtaacacaaagtaattccaaaacgctaaaattagagatgggcaaaaaggtatatggggcaaacagaaacaataagaaagtaggggttgaaatactaatagcagacaaagttgaattccagccaaaaagcattagacttgacaaagacagatagtttttaattcttcattgcagtttacaaaatataacagtttattgccaggtgtggtgggctcacacctgtagtcccaacactttgggaggctgaggtggaaggattacttgaggccaggagtttgagaccagcctgagcaacatagtcagattccatctctcaaaacaaataaaaattcgctgggcacagttgtatagtcccagctatttgggatgctgaagaaggagaactgcttgagcccaggagtttgaggctgcagtgagccatgatcacaccactgcattaaagcctgggtgacagagtgagaccctatctaaaaaaaaaactatatatataacagtttttaatatctatatataatatataattaatctatgtaacagtttttaatatctatgcactatataacagagataccacctctatagagcagaaacgacaggagatgcagagtcacagaaagaagcctactagtgattggagaatatgacatactactctttttcttttttttttttttgagacagaatcttgctctgtcacccaggctggagtgcagtgacgtggtttcggctcactgcaacatctgcctctggggttcaagcagttcttgtgcctcagcctcccgagtagctgggactacaggcacacgccacagtgcccggctaatttctgtatttttaatagagatggggtttcaccccattggccaggctggtcttgaactcctgacctcaggtgatctgcccatcttggcctcccaaagtgctgggattacaggcatgagccaccgtgcccggccataacatactactcttagtacaagtcagatcacgtggacaataagtaggcagatagaagatccaaaaaatacaaccaacaaggtagatactacagatctataatggaactttacactctcataacagagcctacctcttcttctcaagggtacatgggacatgtataaaaattgactgtatattgggtcacaaagaaatatcagtaagtttcataaagaagaaatatttataaataaaattccatgaccacagtgcaattaaattagaaattaataaaataaaaaacaaaaaggtcttatcaaatagaaatttaaaaacaacttttaggtgaaatgggataactgaaaccacaaaaatttttttaaaatgaaaaatactacgtaccaatttatgagatatatttaaagctctgatcagaagaaaagtatagaccaataccagttatgactatcacacaaaaatagtaagtaaaatattagtaaacaagacccaatatcacattaatatacagtgatcaagtggaatttatcctagaaatgcaaggttggttcaaatagggaatttatgaaagccatatactgtattaatagatataatgagaaaaagcatgtaattatctccacagatgctgaaaaagcctttgacaatattcaatgcccattttttattaaaatacgtaaacaaacagacattgatgcatttcttagaggttaaatatatatatatatatacatcccccttggtcctaaatccaacatattattttatgaagaaatattggggacattcccactaagatcagaatgcctgctatctctactaccattcgacattgtagtggcagtataagccaaggcaattagtcaagaaaaattaagtagaggtttataattggaaaagaagacattaaactatcttcctgttgagtatagtggtacacgcctgtagtcccagctacttgggaggctgaggcaggaggattgcttgagctcaggagtttgaggctacagtgtactatgatcacacctgtgactagccattgcactccagcctcggcaacacagcaagaccccatctctagaaaaagaaaacaaaaccatattccagattatacgatggtatacatggaaagccatagaaaatcaatgataaaacagattcaaataataaaaaaaaaacttcaactggtagcaggatgtaaaactaacatagagaattcaatagtctctatgttatttgtatacaataacaataaagagcacatattacttgtacaaaaataataaccagttagagaaaattccatttataccaaagaagataaaatacttaagaataactttaataaataaatatgaaaaacctacatgaagaaaatgttaaaattctcttggaagacacaaaagtagatttgaacaaaggaaaaaggatcctttgttcttggttaagacaattcaacatcaacataaagatgtctcttctccccaaattaatttataaatttaacacaaccccaacggaaacaccagcaagcttctttatggagttagagaagttgatattaacactcacttggataaacaaaaatgtagcatgcacagaaaaacatggggaaaaattagctgcaaaggagctagccctatcagatactaacaggtactcaagtctttaggattaaaagtatagtactcctgtatagacagatggatcagtgaaatagaaagcctagaaataaacccaagtacgtgtggaagtttaatacataaaagaggtggtatctcacatcactggaacaaaaatggttaaccatataaaatcagatccatatcttacagtgaaatacacgagcataaactccaagtggatctgggatccatatgtaaaaaataaaccaagcactagaagaaaacatggaagaactgcattattaacatggttgtggaaaaggtttgtcatgactcaaaatttagatacaacgcctgtaatcccagcactttgggaggccgagacttgaggtcaggagttcaaaaccagcctggccaacatggtaaaaccccatctctactaaaaatacaaaattatctgggcgcggtggcaagcacctgtaatctttgtacagctactcgggaggctgaggcaggagaaatgctttaacccaggaggcgaaagttgcagtgggcccagatcatgccattgcactccagtctgggtgagaaagtaagactctatctaaaaaaaaaaaaaaacaataaaataaaatggataattctgactatagaaaaataaaaatttttcatgcctgtaatcccagcactttgggaggctgaggcgggaggatcacaaggtcaggagatcgagatcaccctgactaacacggtgaaaccccatctctactaaaaatacaaaaaattagctgggtgtggtggcaggtgcctgtagtcccagttacttgggaggctgaggtaggagaatggcgtgaacccgggaggcggagcttgtagtgagccaagatcacaccactgcactccagcctgggcgacagagtgagactctgcctcaaaaaaaaaaataaaagaaataaaaagaaagacaaaaattttagcatttgcatgtcaaaagaaatttaaaaattaatatctttaaaatataaataaacttttcaatattaaggaaagcctaaaaactcaatagaaaaatgggaaaaagagatgaatagacaattcagaaaaagctatgaaaatgcccattaaacacatgaaaagatgttcaaccaaaagcttactcatagaaaaatgtaaattaaaactacagaaaagcttcttgttctggcaggatgaagtaagctcattacagcctctctctcaggctgactgcaactcaaaactctggacaaaatataaaaagcaactacctaaggctgggcacagtggctaacatcattaatcccagcactttgggaggctgaggtgggaggatcacttgaggccaggagttcaagaccagcctgggcaacatagtcagaccctgtctttacgaaaaataaaaaatattagctgggctgatagcgtgtgcttgcaggcctagttacttgggaggctgaggtgggaggatcacttaagcccaggagttcaaggctgcagcgagctgtgattgtgccactgcactcctctctgggcaacagagcaagattctatcccaccccccaaaaaatcccaaaaaacaattctctgaaaacagaaaagtgggcaacagcagccagccgggttttggaggaaagcaaagcttaggacagtgacctacacagagacatgtttcctaggttattcgtatgtgtgttttggggtgctgccctacagttggccctggttgcagagctaccaggcagcagtggctaaaacttggataaaactccaaatttctagatagagatacagagaaaaaggtgcgctacggccccaagaatgtgaggggaaaccctgaaggtttactgtccccctctctcacggtgctgccccagggatggccctgcacacagagcccaggggaaagtgactgagagagaagcttgtctttctgatcaggggaaccaaggaaagggaaccctgcaagatggcaaggggggaaactacagagtggggagagctaaaaaaagttccccaattctgtgaataaatacacagaagcctcaagctcacccctgagctgtgtatacacagggcagacccaaagcagcaccagctgtaagaagggaagtaaaccaacactcaagtctcaggctgagccctgggtggctgatgtgcgagacagaaccaaagcagcatgtcaaaagctctgaaaataaaaatgagattaaaaccacagcccacggagggcgagatggagcttgtgcaaatctaactgggttgactgcctgctagcgccaaactcagctctctctggaggacctcacacactattcaacccaggatatgtctaggatatcatccaaaattattcagcatacaaagaacccggaaaatgagaccaactctcaaggaaaaagccaatttacagatgccaaccttgagaagattcagatgttggaaatatctggtaaaaattttaaagcagctttatgattatgctgcatgaggcaaaaataaacatccttgaactgaatggagggaaaagacctctcagcagagaaatagaaattattttttaaaaaaccaaacaaatacgaatttcagaactgaataatatctgaaaaaaatcaataatggaatgggagatgacagagtgacataaagtgggccaggcgtggtggcttacatctgtaatctctgcactttgggaggccaagacggaggatggcttgaggagttcaaggctgcagtgagctatgatcgtgccaccgtactccagcctaggcaacagagcaagaccctgtctctaaaataaaataaaataggccggacgcggtagttcacacctgtaatcccaacactttgggaggctgaggcaggtggatcacttgaggtcaggagttcgagactagcctggccaacatggtgaaaccctgactctactaaaaaaatacaaaaattagccaggcatggtggcgggcgcctgtaatcccagttacttgggaggctgaggcaggagaattgcttgaaactgggaggcggaggttgccgtgagccgatatcataccacggcactccagccggggcgacaaagtgagactccgtctcaaagagaaaaacaataataataataatataaatataaatataaatataaaataaaagattgagtaagtgaaattattcaatataagatcagaaagaaaaaagattgaaataagtggttagcatagcagggacttgtggaataatagtaaaaggtctaacattaagggcagtggagtctgagaagtagaagagagaaacagatttggacccaaaaattaattgaataaataatgcctgaaatttcacaaacttagagaaagacaaaagcacatatgtttaagaacatgatgaaccataaacgaaccataggataaattcaaagaaaacaatattgaaacatcataaactgctgaaaaataataatgaaaccatggaggccagaagggtggaacatctttgttaaagaactgaaagaaaacaactctatatctagcaaaatattctttggggatgaaggcaaaataaagattcccagatgagggcaaatgagaatttcttgcctacagatctgcactaaaagaaatgctaaagttcttcaggttcaaaagacatgataccagaaagacatgtggaacttcaagaaggtaggaggagcaatggtaaaatgcggttttatcacttcagtaaacatgtatgattgttaaaattgtattatctgttgaggttttcaatatggcagttataacataatggaggagggtaagggacctatgtggttgtaagccttctatattttatttgaaatggaaaaatattaactctaagaagactgtgaagggttaattaagtatgtacactgtcatccctgcagcaaccattaaaaacataacacaaagagatactgccaaagttccaacaaaaaatcaaaacaatgttttaaaatacctaaataattcaagagaggacaggaaagaggggatagaagaaaaaaaaagaagagaagaaaaagagaaaacaacaaaatagtagacctaaatataaccataccaatcactacaataaacataaatgctcccaacatgctaattataagacccaactataagctataaaaaataaaaaggtgaaaaagatatgctatacaaataataaattgcagtggatatattaatatcaggcaaagtagacctcagagtgaggaatattatcacggacaagaagaagatacaatgataaatggcatcgattcagaaagaagacacaaaagttgtaaatactgagctaataagagaacttcaaaatgcatgaagaaaaaactgatggaactgaaagtagaaatagataactacataattataggtggagacttaaactcctccttagtaactgactgaacaagtggtcaggaagtcatacagaagacctgactaatactatctacctacttgacctagttgacatttatagaacatgccgctcagtagaagaaacacattcctctcaaatgcacatggagcactcatcaagataggccatatcctgggtcataaaagaaaccttaaaaatgtaaaaaaaaaaaaaaacaaacaaacaaacaaaaaaaaaacctcacgcctgtaatcccagcactttgggaggtcgaggcaggcagatcacgaggtcaggggttcaagaccagcctggccagcatggtgaaaccccacctaaaaatacaaaaaattagccaggcatagtagcgcacgcctgtagtcccagctatccaggaggctgaggcagaagaattgcttgaacccagctggcggaggttgcagtgagtcaagatcgcgccactgcactccagcctgggcgacagagcgagactctgtctcgataaaaaaaaaaatgtaaaaaaacaaagtatacaaagtatgctctctgatcatatggaattaaactggaaatcaataacagcaagataatgaaaatctccaactatttggaaattaaacaacactgttttatataatcaatgggttcaagaggaagtcccaagggaaattagaaaatatctaaactaaatacaaatgaaaacaccacatatcaaaacgtgtaggatgcagctaaaacagtgcttagagggaaatttacagcattaaatacttacatcgacaagaagaaaggtctccaaatcaatgacctggtttatgccttaagataacagaaaaagaggacaaagtaagcccaaaacaagcacaaggaaggaaataagattagagcagaaataaatatttttaaagaatagtaaaacaaatgagaaaataaagcaagaggtcggttctttaaaaagatcaataaaactgataaatctctagctgaactgacaacaataaaaagagaagagacaaattataataattaaagaagggttatcactacagacaccagaaacattaaaaggataaggagatactatgaacaactcaaataaattcaagctaaataaacctagctgaaatgaaagttggaagacacagactatgtgaagaaagagaagacctgaatagtcctgtatcaattaaaggaatcacatttttagtttaaatccttggggaaaaaaaaaaatcaaaattccagcccacatgactttactggcaaattctaccaaacatttaaagaagaaataacactattctacaaattattttcccagaaaacagaaaaagagagaacatttcccaactaatttgatgaggctagcactaacccaataccaaaaccagacaaagttagtagaaagagaagaaaaccacaaacaaacatatttcatgaatatagacatacaaatcctcaaacaaaataatatcttgctgcttaagtctcaagttggggagggaaaaacagcaaatctaatccaacagtgtagaaaaagaatacactggagccaactggcatttatctcaggaatgcaaagctgattcaatattcaaaaatcattcaatgtaaactctcatgttaacactaaagaaaaaccacaggatcatataagttaatatagaaaaggcactgggcagaattcaacatccattcatgatttttaaaaaaaccctcagaaagcataatccataagataaaaaacacaaattcaccttccacaaaattagaaacctttgctcttgaaaagagattttttttttttttttgagatggagtctcgctctgttgcccagactggagtgcagtggcgcgatctcggctcactgcaagctctgcctcctgggttcacgccattctcccacctcagcctcctgagtagctgggactacaggcgcccaccaccacacccggctaattttttgtatttttagtagagacggggtctcaccgtgttagccaggatggtgttgatctcctgacctcgtgatccacccgcctcggcctcccaaagtgctgggattacaggcgtgagccaccacgcccggcctgaaaagagattattaagaaaatgaaaagacaatctatacagatggggaaaaatattttcaaatgatgtatatggcagataatttatataccaaatatataattttcaaaatccacaaggaaaacacactcacaaaataaaaccactaagaatgggcaatagatttgaacaaacacttcaccaaagaagatatgcaaatggcaaataaggacatgaaaacatactcaacatctttagtcgctaggaaaatgtaaattaaaaccacaataaaatgccattacctacttatcagaatggctaaaacagaaaagactgaccattccagttgctggaaagcttatgaagtaattgaaactctcatacgctgctgatgggattataaaatggtacaaccccttgggaacaaagtttggctatttctttaaaaaccagtcacatactggagacaacccaaatgcccatcaacagcagaagaaacagagctatatccacacctggatatatccatccttgacaatgacaaagtaggaagtactgatacatgctttaatgtgaataaatctcaaaataatcatgtcaggtgaaagaagccagaaaaagagagtaaattctgtgattctatttatgcaaaattctaggagatacaaactgacctacagtgacagaaagcagattaaagggaacctggagaagagaggtgcagggaggaagaagggaggggcatgcagagacgcaggaagatactttaggcacagtgggtatgttggttgtcttgagcgtggggatggcgtcacagacgccgcacttgtcaaactgtccacttgaaatatgtgcagtttattgcatacgcaatttaattgcacaatctatttttgtgctcattaaaggaaatgcaagagcaactaaacaatccaattaaaaaggcataaaagatttggccaaacactccacctaaaaagatgtgcaaataagcacaaaaggcaactcaacatcatagccattagggaaatgcaacttatgcccataatgaaataccactacatacctactagagtggctaaaattcagaaaaaaactgtcaaaaccaacaaaaccaagtgctggcaatactgtggggcaactggaaccttgttggtgaaatgcaaaatggtgcccacactctggaaaagagtatggcagtttcttatttatttatttttttatttttatttttattttttttttgagacagagtctcgctctgttgccaggatggagtgcagtggcacaatctcagctcactgcaacctccgcctcccaggttcaagcgattctcctgtctcagcctcctgggtagctggattacagacgcctgccaccgcgcccggctaatttttgtagagacagggtttcaccatgttggccaggatggtcttgatctcctgacctcatgatccacccgccttggcctcccaaagtgctgggattacaggcatgaaccactgtgcccagcccagtttcttataaaattaaatatgcattaacatgttgcccaacaattctactcctagatatgtattctagagaagtgaaaacttatatgcaaacaaaaacctgtacatgaatgtttatagtagttataactaaccacccaaaacagaaatgtgaaaactataatctcctaaaacagaaaataacccaaatgaccatctatggatgaatggaatactattctgcaacagaaaggaacaaactattgataaatgcaacaacgtgggtgaatctccaaagaactgagtaaaaggctacacactatttatatggcatcctggaaaaggcaaaagtataggtacagaggacagaccagtgactgtcatggatcagaaggagggggaggggatcactgccaaagggcagcaaaaggcagggttttgagagaatgagaagttttctgtgtcctgattgaggtggtgttgacacagacatgggttaggactcactgtaagcgcacacaataataaagataataacaataatacagtagttccaccttatctaggggggatgatgaatgatgatgatgaaaagtatctagggatacttttcaagacccccagtggatgcctaaaaccatgaatagttctgaaccctatatacaccatgtttttccctacagtgtacatatatacctacgggaaagtttaatttaaaaattagagacaggcacagtggttcatgcctctaatcccagtactttgggaggccaaggcaggaggatcactgagcccaggagttcaagaccagcctgggcaacacagggagaccctgtctctacaaaaaataattagctggggcagggcacaatggctcacacctgtaatcccagcactttgggaggctgaggcaagcggatcacctgaggtcaggagttcaagaccagcctggctaacatggtgaaactctgtctctactaaaattacaaaaattagcccaggcgtggtggcaggtgcctgtaatcccacctgctcaggaggctgagacaggagaatcacctgaacccaggaggtggaggttgcagtgagccaagatcgtaccactgcactccagcctgggcaacagagactccgtctcaataataataataataacaataataataataataataataagccaggtgtgttggcacatgtctgtagtcccagctactcaagaggttgaggtggtaggatcacttgagcccgtggagtttgagactgcagtgagctatgctcacaccactgcacttcagcctaggcaacacagcaagatcttgcctcaaaaaaaaaaaaagtatactatgataaaagttatgtgaatgtggtctctctcttacaatatcctgttgtattgtactcacctattttcagactgcaattgaccatgggtaactgaaacctcagcaaaagtgtagatgagaggggagctagtgtcgtaataaaatgcccatgagtccacactgaggtaaagaaatgactaaataaacaaatctcccaaacagaagaattccactttatgcagacactctaccatcaaggaggagtagataactcccaaccgtttaaatatgggttatgcagtgactcccttcctaagaggagagtacggaaaggagagaaaaacagccactttacagcagaaacacctgacagataccacctccgccaggtgatgacgctcagcatcagcagggctaggtcatgctgaccacacgtcccactgacatgatagaaaatccaggaatgggccaggtgcatggctcacacctgtaatcccagcactttgggaggtcgaggcgggtggatcacttgaggtcaggagttcgaggccagcctggccaacatggtgaaatgccgaccctactaaaaatacaaaaattagccaggcatggtggcacgtgcctgtaatcccagctactggggaggctgaggcaggagaatcgcttgaacccgacaggcagagattgcagtgagccgagatcgtgccattgcactccagcctaggcgaagaagcgaaactccgtctcaaaaaaaaaaaaagaaagaaagaaaaagaaaatccatccaggaatggcattcaacctttgtgcttttcttcccaaaacccttaagctcagtctaatcgtgagaagaacacaacaaatcccggtggaggaacattttacaagagcctgaccagtgctcctcaaaacttaaggttatcaacaacaagaaaagtctaagaagttgtcctggccagaggagcctggggagacaggagagcaaacgcagtgtggggttctggatgggattctgcaacagaaaaggacattagggcaaattcaggaaccctggatgaagcctggactttggtcactaacaatgcatcaatcctagtccattagtcatgcgcagagcaagatgctgacaggaaaaagggctcagaaatgcgtccgtgcacaaggttcacactcaaccactgctcttggccacagtctcacaggttatgtttcaaataaaatatattgtacaagattcttgtgctattttttcttgtgttacagttaatggtatttaatttacactaatgtattatgaaacttcaattcctgtttctggctttggagtcaatttctatctctactcaaggtgacttaaacagacttaatgagcctgggcaacatagcaagacccccatctctacaaacaaataatttaaaaaaatcggccagttatggtggtgcccgccatgatagtcccagctatgttggtggctgaagcaggaggagaggatcacttgagcccaggaggttaaggctgcagtgagctatgatcacactactgcactgcagcctagcctaaagagacctgcctctaaaataaacaaacaaaacagacttaatgtcaacttttacacgcttttcccattccaaataatttactatcttatttttgccctaatataaattcatcaacagtgccccctggtacaagctagtagttattcggttaagcaaatgagctgatgacttttatgaccatcgttacttccagaaggtgtccccagccagctggggacagaaagagcactgatctaaccactgttgcgcttcaccagcccagcccacctaatttctctatgaagtagcacagccgttctagcatgaagatgttgaattggctggtcctccaggccagcaagaacatgaagccaaggccatgaggcctgaggcaggcacacaggtggctggtgaatgggctccctcccacctcctgctcatcaggcacctcccaggctacacctggaaccagaaaggcactccctggacaggcctgtcctgagcagagacctcagtgtcatcccctgccttcctggtgaggaagacagcagcagtaaggcccagaatctcagaactgtccgctgcattgcagcctcagccagcgaccctgatctcccaaaaagcctcacacacaccactccaagaagctgcatcagacacagagccctgggctatcccagtcagttcactggcacacatctcagtgctgctgcttcaaaccaggaaactgaggtctagatacacccttccccatctctgaaatgcagggagatcagcggggagtcagtgggggcagtcagagactagcccccaacaacccttctcagtcactgatgtctgcccaccaaggcctcgggggccaggattgcttccatggccttggctctcagcccaggacgggggtgggagcagcctggtgagtaatgcccaggcccccaagaggtggtcctgccataaataatgccaaggacacatcccccttcaagggaggccagacctgccagggagggctgcagaaaagctgcactctagctgcaaacaggaagggatgagcctgctcagatggtgaggtccctatcctgttacctgccactcacggccacaaaggaccagaaaccctccctgggcaaggaaaacatgctgcacctccctgtttggacccacggctaccagggccagctactggagataccaggactctgctagtgtcacctggcctgggaaggacctaagcagctcaagctggccacacagcagccacagccctggccatggcccccacctgcccactcccactgcagccagctccctgtcctgagcacgggaaacaggtctaccagcactaactcaaacttcacaaagaaaccatttctggaatggggctccgtttggcgattcggagtcaaaggcgcacttcatagctcctttccaaatcccgtgcattgtcaggccctgttcccctttgaagcctcgctgagtgattgaagcgtctactttctgaggggcagatagcaccgggctggtaatctgactctaagccacgggataaaggtagtttgtttcctctcagcccgtctgtcaacacctcctcagtaattagccctaattattacagagggccagcctcccattcggttattaaatcagaaatagtatcacggctgggcatctgtcaacgccccgactggcgaccttcgattcattgaatcctctgtcagtatccgcctttggaagcgcccaggcgggcagggaggcagcggcttcaaagatgcagatcccaggaagaattccggtgaggcagggaggcagggagggccggtgcccagcagcccgatggcgagggggagccaggcaccgccccccgggcagcaagtgcacagcccaaccccagcaatttcccacctcccagggctgaccgatgtcagtctctctgtggcggggaataaggtatgccccccaagaactccttcccttggagaagaaagcacctccaggcctgcatcaggcatatccgtctcagggagtggccctgactgacaacttggcctgaggcccacaaagccctgaaccagctcagtgcagggaggggaacccgagccccggctgcccagagcactggtaagctggcaaatctgcaaagcagaactcagattccagccatagacacgatttccatagtggagatgagagtgctacagtcctgtaggccccgacgaaggacagccacccatctcccttctgggtctgagtctgttctccatcctagagaaatggtcatttgctctgccacaggggccttctgctctggcaaagcacctccaccctgctcccctagggtatagctgccccccagcaagattcactgcctcaggccaggggccggcactgacctcacctcacctggggcagtggcccaggtgccccagggctggccaccagcacttctccagagactgagacccacagtgccccacccaggactcctggcctgcagtgagccaggtggggcccagcacggtgcctacatgctgaaccccaccaggtctgtgccgcccccttccagataggccctgctgcgtgtgagggagggtcccagagatcagtcacttttgctggggacacgcccaaatggcgtgattcgttcccgagcagagacaagcaagttcctctagacagcccactgcagcctgttctcccccgaggcactgccagtccctgctgggtgctctgccagcactttgggtcctcgtggccaccaaccacccaccacgctggcagggggagtgggtctcatggagacaaggacatggattagttttcttccttggggatgcctggaagcctcatggctggggcatgaggagtgacctgctggccagctccacagtcagcaggggcgccaggcaggcgctgaggctgcaagtcagacttctcctttgcactgggacacgggctgcctcagctgagccaagaggaaatgccagcgtgaggagccaccaggctgcagaggcaggcaggatgggcaggcggggtctctctgtgagcaggcatctcacgctgtggctggggatgtccgtcgccccaggagcgggtcccaggagcctggcaagatggcaggaaggaagcctgacttggacattgttagccagcctgccccaggcacttacgggcagaggcaggaacccagccagcagagggaccggcctttttgacccgggtgaacacacggaaaagctcactgctttacaggaagcgtgacatccccgtgcaccagttcagcctctgctcagaggcctggttcatgtaggccagctgccgatcccatcagggagagacaacactcacagagggtgcaggatggggaccaatcccctggggctggtgcccctggcctcggggatggggatgtgccctggaaacttggtcggagctggaggaggggtccctaagcaagctggggctgacactttctgacagggacttgcctgtgtggctcctcctgtggcggaggcaaccttgggtggaaaggggaggtcccctatcacacacaggtggtggtgtggccaggtgtatgtctcatcaactcccgaccacccagctgcatgcagtcagctgtgcacatgcttacatatgcatgccagcaatgtgcttgcccacatccacagacatgcgaatgaggacagaggccagcctcccactcgctctgccctgtgggtgctgcaggtggacccctcactgagggccccccctatgcacagcctgtgaataaagagccctggctccacaacccacaaacactccccagtcccctgcagtgctcagacacagaggtgaggtgggcagcgcaggcacagcagggggcaggggagtcagatgtcctgtgcacccagctggcagccccaccaatggggacacagaagaatgtggcaagtgcatgagcacccatcatccacaggccccagccctgtgctgggggtggttcctgaggccaggaggaaaggagccggccaatgagaacaccccacaggcctgggctcttccttggccagcccctacccaccgtgtccctgtaatagagatgatgtagcccaaagaaaaactaagggagcaacgggccctgctgtcctggagagcaggcttggccaggctgtccagcgacaaggcacccccgaggcctgcaccaggagagtgtgaacactgctggggctgggcaagggccatgacaccatcctcgctgcctctgcatttgtgatccaatgtgttttaaaacttgcaaagacaacttgaaaaatggggacatggatggtttccctatgacataagcaagacttaaaagctagaataactagtaagggacagatcagaccagagagcaggcgggtaggccaggcatggctcacgggtggctgcagccagactgtgagttgctgcagccagcagctgatgctgaggtaggccctatggaaaaaggtgaaatgggatcccctgttggtcaggacataataggttatgctgtggaaaacacaagccccaaactcagtggcttcgcacatcaaaaatttatttcttgctcatattacatgtgcatcgcggtcggcagaggggctctgctcatcacaggctatcaaggatgacagcagacccctcccttctgccgcagttacacttacaggtggactcaaggttgaatgtcaaaggcagaaagttacaacctgggaatacaggataatgcctttgtaccccccaggtagggaaagatttcttaagtgagaaacagcatcccatacagcacaactgggcactgcctactcaacagccaaggcttggccatccccactcctcagtatgggccccagaacccagggcctgggggactctgcacacaggcatgtggagaccacagaagcctgcccaatatagcgctgccaggaacagcaaagacaaaaccagagaagcctatcgcgggcaccgctgtgggcagaactatgtcccttcaatatttttatgttcaagtcctaacccctagtacttacatttgaagacagggtctttaaagaggtaattcagggttaaatgaggtcatgagggtgggccctgatccaatagactagtgagcttatgagagattaggacacagacacagacagggacacggcaagaagatggctatctgcaggccaaggagcgaggcctcaggagaaaccaaccctgcccacaccttgatctcaggcttctagctccagaatcatgaggaaatgtctgttgtttaagtcccctagcctgcggtcctttgtcaggcagccccagcagacaaacaggtatgttgccctgggatggatgcaggcccctcccatcctcccatcctcagcagcaccaaccagccccacgctgggtggctgcttgtacttctccatactgagcaccccagcccataggatgatcagctgctgccgtcctatggaactcaggtgtggctctgtggcttcctttggccacagaaatggaagtggggtgacacacattacttgtggcctgctgtggcctttcccctgcctcagtgagcatggagaaatatgtccaggtaggctgtcgtcagcacaggtctgacaggccccagccacggtggcccacaggtgcaagcaagaaataagcagtgccaactgtagccgctgcgctgttggagatctttgttactgcagcacaatctggctcatgctgactgatcctgcagggtaacagctttatttgccttgctcctttattgctggatctttgggcttttccagttctgctgttcaaaaaacagtgacacccatgaggtgggtgttagagggcccagaccccagccaaggcactgcatgggcatcattctcattcaacccttctaaccaccccatgaggaaaaactctggtcacagctcaaaaaggtcaggtaaggaccctcagctcatgcggggaggggaggaggcaaggccaacctccagtccctgctctaaacccccatgtagtggtaccgaaccatgaccacccctggcaagagccttcatgcacctagcaagtagtcacagcatgcatgtgcctagaattgttacgtggtcaaattatattattgtgtattcccaccaacagtatgagaaggtccacttctccatacctccacaactctgggcatctaaaacttttaaaatcctggaatcataggcaaaaaaaaaaaaaaaaaaaaattcacccatattttcctctagtactttcataattgtaacattgaaatctttaatctggaatatgtactggcataaagagtgaggcacatacatggctttactattttccagagggccaactgcttttactgaataatccattttactcgttaattggaaacacctctagcctgtactaaatttccatatttatttggcccgtttcaaagtcctctattctctgctcatctgtccacatctaagtgctttaactattgtggctttataaaatattccaatatcccataggaccttatccttagtacttcctattttaaagttttccttgcagacaggtactttaaataccatctcacagcacccatcatgtcctatcttcaggaaataaaatctctgggtatttccaagggaagtgaaggactgacaccatgattagaaagcagagccagcaccatggcccgtccctgagcatgtccagcaaaccctgccaggctctgcagctcctgagcaccctgccttcgggtctgccagtgtgtgggggccagaagagaaaaacaacccagggggaatgcctccttcccccagcaggaaagcagcttggtcatcatctgtctgaaagcaggtgctgcagcagctggcaacaaagccactctgaaaggagctgtgtgcactgcctgtctggaaggccatgccagagtccatcgttgcctccaccctacctgtgcaggaaacctggacatcaccacttcaaggccctaccttcctttctgggcagagcccaaccacaataaacaggacgcgttttaattaaaaaccaggtcacctggactctcccaaggactctcaagcctgcctaggtggatgctgcatgactggccctcagacacacggcagaccataactcacacacccccaggagctgcctgggtcccaagggcacaaaagccccaaagccccaataggacagggttcaaaagagaaggcagcaatcccaggctggagtatccacttcaggtccactaaagggagatggggaaggtggcctgtccagaagcctgtgggacagggtaaaggtcagctgggtgactaggctgtccatcctagagagcaactctgggttctactgccagacccacaggtgagccaggccacagtgcactggaggtaggcatcagggagcagtctgacccaacccacaaaaggggggatggggcctgagtcatcggacggagggcagctgtgacctggcacagaagcatggggctgggccaggacatccagggacttctcacatctgaccagaatcaagactgaaaatgggtttcttctgccagctcacttgctttgctaccagggctatacctgctttctaaaaatagcttcccacctatttccaaggtttccagttgttttacctacaaggtatctgtgccctgaaataactcacacataaaaccatctgaacccagagccttttctagtgatagttaccataaaataatcccaacaatttatatttttctaaataaggtttttgttttttgttgtttttttttttttgggatggagtttcactcttgttgtccaggctggagtgcaatggcgtgatctcggctcaccacaccctctgcctcctgggttcaagcaattcttctgcctcagcctcccaagtagctgagattacaggcatgcaccaccacacttggctaattttgtatttttaggagagatggatttctccatgctggtcaggctggtcttgaactcctgacctcaggtgatccacccaccttggcctcccagagtgctgggattacaggtgtgagacactgctcccggccagtttctgaataagtttaatcagatgcttgctaattagtttttcctaaaatagttggctgtatttccaattcacatttctgctttttcttcctactttccaggaaggtgttgttttgttgttttcacaattgtaaacctgaaagggacttgaacttcttgtccaagcaccagagtgggcacacactgcacacactgggcggctgtacctgcctatcctgtggtaaacttggctccaggagcttccaagctcagcttccactagaaaacccctccttgtgtggaacaggtctttcttcattccattcctctgggcctggggcctcacagctctggactgctgcctggtcctcacttcacctacagctctcggaagtcagttctctacctgcagagccacccaccccctactcagccccacccagcttctttgatcagacccttggaccctcaaagcccctgccagaaaccacagctgcaatgctgacctggaatgctcatggccaggcctctgctcctgacagaatgggaaacaaagacttgctggtaggcagccactgcaccacctcagccagtaatccaacacgtgtttaatgagcaccaattgtgtaccaggccacagagctgactaagacagagcccctgtgctgagggtcacagtctgccaggagggagatccaagtcatttacacactagggcttaagtgctgaatccgcaatgcatgcgagtgcggagtgagcaggggatggcagcacagcagcagggaagaggagcctgcttcagaacaccaggcacgattagagctacagtgttaacacacaaagggcgaatgcctgcagctgagcctggcaaggggcttgcatcccaccttcctgcatccaaaccttccagctgcccagaactgctggtaatcccacaggaaacatcattctttgccaagatgctatcccactcatcccccagaatcaaagtggccacttcctccaggcagccttcctcacattccagctgggacagaagtcacagggagcagagagggtggggctagggggacagacacagaaaccccatacaggaacgaggtcccaacagggcagacgtggcagacccagttcagtcccagccagtgtggaagacaccaaggggggtgttttatgggggtggaggtgacaaagatgatgcaactatctgctgagagttgatctacaaaacgaccccctcgtgggagcaggcctgggtgagacggcactcccagaagacgggcagggatgcagcagagagccagcagcagggaaagggcacagggcggaggtcaagctctgctggagttgggggagctggttctgctcagcgcagagtccaaaacaagcgcatcttgcccagctatggggtctgaagtcatctggggacaccactctgctctgactggggactatggggcgctcaagccacacaggccacttcatcatgaggggcagcattgttcccacctgggctgtgttcagaacccaggagaaagtggtggctctcctggggtctccggggcctccaccacctcctgtggggtacctaaggacacctcctggtctccctctgtctccaaaacctcctcctctgttttctggggttttggacctcctggatgagctgggtctggtctctgggcaggaggattagctgactccgacagtctagggacaggtgtgggggctgcctcctctggctgggaagaggctggttccacaggaccaggcttggagctacatgtagaactgggcaggactgggggctccttgggcccaggggtgctctccttggtcagctgctgctcgaacagagcacttctagatacagagttggacccagacacagcaggggtggccatggcggctggtaaagacctgggggcagtacccatgtcgagtgccaggccctctaagaacctagctaagtattgcctcaccacaggcagctgaggggccactggcagctggctggaggccaggggcaggggacaggtaaccacagcatggtactcagcaaaactgttcgggtcttgaacaacttccttgagatcctggcagaagagctcgtaatcgtcaggcaggggcaggtccccatcaaggtagggggctgcccaggcctgggctcggcctgttaggcgcctgaggatctcgcagacacggctgatgttgtcctgatagtgctcaaagtggaaggacatgtaatcgcccagctgggccaagaagcggtccagtagccacggggagccatcaaaggtgcctgggtctgagcctggtacccagcagaagtccaccctgtggggtcgggagctgggcatgtgcccagctaggggacccctttctgcaggtttaccgccacaagtgccactagctgtgctcttctgctccatggtcgttcgcacacacacggtgtccccacagcagggccgctcaatccagggatccacaaggggggtgtatgccaccccaggagacgccttgtccatctgctgccatggatgtgcgttggcataattggcggctgcccagatgggaatgcgagggccctgctgacggcaccggccacgaggcatgctgggagcacaggggagaagagaggagagccagcactggtgggtggtgggggtgtggacagatgtggcttgcacgacacaacaggacagggatggctgaacagggcgtggcagacccgcactggtccaggcaagtgctgaggatcagggagctgacagctgcagcctcaggagagctgagaagagctgagagactgtcagtcgcaggccatcatccgaggcaatctgtccaaagacaaggtggggaagagcaggaactaggcctaaccatcacccactggactggtgggaagaggctacaagcgggcaaccctctggtacccaactaggagctttgaatggaaggaggggcccagggggctggcctgggaggtctgaggtgggcaaatgctgcctatgacattgcaagggcaaggcagaatgacagatgctgtcaatttcagaagaaaaggggccagatcagaactgtcaggaatttcaggatagcaatagtagtaacctttcactgagtgccccatttgtgccacctcccccacaggaggttggtactagcattgtctttgaggcacacagtggtgaagtaacttgtctgcagccacacactaacccataagtggtggaagcagcaaaaactggctggagagaccagaggcttaactactatacagcacgcgattataaactacatttgtctgctgagtaggctctagccgccccaaaaactctgaacaacgcacagaccgcgtcgtcattaggctcttttacatcccagcaccaggcacacagcaggtcctacctgcttccccgacagagcagtgagcctgctattctctgctccctcctgaccccacatgctttccaaattcacctctcacaactgagtgccacctgcaggcaatgccacccccacccacaaacaccacctttccacagtccccatcccagccacagcagagcatcccagcccccaccattgtaaaatcctggaaccccacttgctgtctgctcccgccactccagtcacttgtgcccagggtctggggagtcccagtctgatggctggacccgcccctccttctccacgcagcagtcacctaggaggctccagagccagtagccagttctattccagtgcaaggagccctcctgtagggctcttacactctgcagcctaactctatctagccccctccccagtctctctgcaaacggaggcccactcacgacctccaggaaactctctgcttcaccccacacacaaacgccaccggctcactgggagcacaaggcctgcacacaccttcatcccacatctcctatctgctggccatcccccctcagggtgagttcctccaggtacctcccagggtggcctgcagcactagaacctgccagggccactggccctacctccaccacccaaacactctggaatccctcaggtctgacccccctctggggggggggtcttcacctgaaagcccagcccatgaccctggcttcccaccttactgcaggattatactaaggcctggacgtgagtcgagtccagtccagtccctcactgagctctaaaaaagcagtgaccccgatccagggcccagctcccaccaccagccaaggttaggtatccaggttgcccacaatgaccacaccccatgcccgggagccacagtgtgctacccagatctctgccttcccttcttcccagtcccctaccctgcccactcacctgcgcacctgtgtcccctgcagtctgggagaaggcttccctgcaccagccagccaggcctgctttgggcctgagccttcctaaccctgggccgcactctcaccattttgagaaccttagccctcccacgcctatcagtctgttggtccccctacttttctccccacactgcctggcatagaagactttcggcccttctagactggacagcactatcctaaaggggcaggtaccacggcgcatgtgtgtttgcccccacaaggccaaaggcagcacctggaacgctggagccgttctctgctctggggagacccaggagccccaagaacaaaacctgcccaaagccttaaagcaagctgagtgcagacgactgcaccgcccgccccccagcaaccgccatgcaggaaatacgagctcacaaggcccacggcaacaagaagcccacccacctgaggctacgcgaatcgcccgcgaagagggtcctgggatccgtagccacagaccgtgggacgggcctccctctgagggcgagagtccaggcgccacctagaaagtggagaacgagatcggccgccgtgaggccaggcaaggagcgggcgcggcttcccgagactgcgagaacggcccaaatgtctccaggtgcccccacaaacccccggcgcggaccgagaaactgaggcccgcagaccgaaggcactgcgacccaggctggggctccgagtgcccctctgcggatcagaagtcgggaaaagacgcaggggcgcagctccaggcccgcgtgcacggagttcaagccggccgcccgggctcccgcctccacactgaccctcttgccggagtcgggaacgcctgctcctaggagcgccgcgcagcgtccagagaccgattacatcgcgcagccacgcccccagcgtgcgcgcggccgccgtgtacgacccggcgcatgctcccggcacgctccacgcgctcctcccatccaggccgcgcctgcgctgtatgccgtgtggccgctacctcgcaggctctcccggtccctgctggcgcggcagtgccgcgcggtgggtgatgggagagcgcgcccattcccacgccgcgccaagtgccacgggatcaggtggggccgcgtgtacaggcgcgagacggtcgggccaaagctgcccctcatgatccccagcggacggtgcccggcggtccctcagatccgggaaatctgcacccggctgtggcgtagaccgaggggccgatgctgcttcagcccgccgttactgccctggcgtcagccagacactggggtgctgctgggcgtcgagagggctgctgcggggccgggctaagcctggggggctgcaggtgtcggggtggatgtgggcatagcggggctgctgggcctcgtgagcgccctggaacggcgtgcccgcggagtgcctctcatcactcattgccagtgcggggaaccttgttagggcccggttcgacgtagctgcaggctgggcgccagaggcagggggcaggcagtccgagaggaccctctacctgcatacctgggggctgcaggcagggcctctgggcctccttgttgtggatataattgtgtgcttcccgactcaggccgaggctggacccggagacgacagcgagggcaggctaccaagccctccccacagggccgtgcccagcccaagcctgccgagtcagcacccagatcctgggacaagataggtgaggatgaagtggtggtgctcttctcacttgcacaagccgtcccacgccacctctcctcggcttcacggtgcctagagaagaggtgggagagggtgcaggcgccccagctcaggatctgatgcctgtgggccaaggacctggatgcaagccaggagtccttggggccacgggcaggcagccggattcaccggaaagtgacgcttctcaaggggaacacacacgtaacacaccagctccctttctgccctggtccagtgactcctttcatgaaagctctctgaaatgttatctgcatttacacccaaactcactcactttgatccctgaaacgcgaatcaaaggtcacattgtaccttccctgggtctgtggggctttcagcagcctgggccaaaaataataaaagtggcaccgagccaggaaacgcctccttgaagtgggaatgaaatttggatttttttcggttgtatctttcctaattgacctgataatttaaacttcctccctcaagggaaaggtgggggttcccacaaattcagcttacctcagcctcaaggcagctcagtctacagctcagcgcccatcagcagagtgggcagtgggcctgtggaagaaatgaatccaactgagccagaaaaggccttttttggtccaaattttttttttctttcaggccctctcctgtgtataactgtcatgcaccgcataacaacgttttggtcaactagggaccacatatgtaactggtcatccagtaagctatagttattttattattgaagaaagaaaatttttaggccaggcgctgtggaggctcatgcttgtaatcccagcattttgggagcccaaggcgggcagctcatttgaggtcaggagtttgagaccagcctggtcaacatggtgaaaccctgtctctaccaaaaatacaaaaaattagccgggcgtggtggtatgtgcctgtaatcccagctacttgggaggctgaggcaggagaatcgcttgaacccaggaggcggaggttgcagtgagctgagattgtgctactgcactccagcctgggcaatagagtgagactccatctcaaaaaaaaaggaaaatgtttaatataagtgtgttgcagcctaagtgtacagtgtttataaagtctaaagtagtgtacaataatgtcttaggccttcacattcactcaccactcacacccacagcaacttccagtcctgcacctctgttcatggcaagtgccctaaccagttctattttttattttttgcactgtacttttactgtacctttgctatgattaggtgcactaataccactgtgtcacaattgcctacattgttcagtagagtcactgtgcaagtttgtagcccaggagcaacaggccttaccatacagcctaggtgtgtagtaggctctaccatcttagtttgtgtaagttactctatgaggatccctccatgacaaaatcgcctagtgacacatttctcagagtgtatccccacagttaagtgacatatgactgtttttttattgtggtaaaatatagtaacatttaccattttagccatttttaggtatacagttcaggagcattaagtacattcatgctgttgtatatccagtgatcactatttatttctagaactttttcttcactccagaacattaactcctcttcccctcccactcgcaacccctggtaaccatcattctatattctgtctctgtgaatttaattactctaggtacctcatataagtggaatcatacagtatttatcattttgtgactggattatttcactcaacatgttttcaaggttcatccacatcgtagcatgtgtcagaacttccttcatttttaaggctgtgtaatattcctttgtacacattgaccagattttgtttattcatttgttgattgacacttgggttgttttcaccttttggctattgtgaataatgctgctatgaacattagtgtacaagtatatgtttgagtccctgctttcagtacataagagtgaaattgctgaatgatacggtaatattttgtttgactttttgagagattgccaaacttttccatagcaagtgaaccattttacattcccaccaacagtgcacaggagttccaacttctccacatcctcaccaacacttggttaccttctcttttgtttttttccaatagccatcctaacggtatgaagtggtgtcccattgtgattttaatttgcatttctctaatgactagtgagattgagcatcttttcctgttattggccatttgtatatcttcactggagaaatggctattcaagtcctatgcccatttttcactggatttttgtttttattgttgagttgtaagatttttctagatattctggatattaatcccttgtcagatatatcatttgcaagtatttctccataggctgccttttcactctgttgatagtgtcttttgatacacagaagtttttcattttcattaaaatgtcattaacttaatttcactaaattaatttcattaatttccaagtctaatttgtctatatgttggtggtagtggtggtgttatatctaaatcattgccaaatccagtgctatgaagttttgccctatgttttctgctaagttttataggtttaggtctttatatttaggactttgacccattttgagttcatttttacatacggtgttaggtagggatccagcttcattcttttgcatttgaatatccagatgtcccagcatgatttgttgaagactatcctttccctatcttagtacccttgttgaaaatcatttgaccatatatgcaagggtttatttccaggctctctagtctgttccattggtctgtatgtctgtctttcttttttcaggaaagtacagtgttcaaactacacagtcttgattactgtggctttgttttaaattttgaaatcaggaagtgagaagcctctaagtttgttctttttcaagatggttttggctattaggagttcctacagattccatatgaattttaggatgggttttatcttcctttcttttttattttttttatttttttttttgagacagaatcttgctctgtcgcctaggctggagtgcagtggtgcaatctcggctcactgcaacctctgcctcccaggttcacgccattctcctgcctcagcctcctgagtagctgggactacaggcacccgccaccacgcctggctaattttttttatttttagtagagacagggtttcaccgtgttagccaggatggtcttgatctcttgacctcgtgatccacccatctcggcctcccaaagtgctgggattacaggcgtgagccaccgtgcccggcctttttttttttttttttaaactagacacagggtctcccctgtcacccagactagagtttagtagcctgataatagctcactgctgcctcaaattcttgggctcaagtgatcctcctgcctcaacctctaaagtacctatgactacagacatgtgctaccacacctggctttttgttgttgttgttgttaaagctagggtctcgttatattgcccaggctggtcttgaactcctaggcttggcaaaatattgggattacaggcatgaacaaccgaacctggcctgtgataggtttttatatttctaaaaaaacactgttgggatgttaataggattgcattgcctctgatgaccactttgggtagtactgacatgtgaacaatattaaactttccaacacaggatgtctttccatttaattgtgtctttaaatggatataattgaacacaggatgtctttccatttaattatgtcttctttaatttctttcaacaatattttgtagttttctgtgtacaagtctttcacctccttggttaattcctatgtattttattctttttgatgctatttaaatgaaactgctaatttccttcatgaagtgttcactgctagtactatatagaaatgcaactgatttctgtgtgttgattttgtatttgacaactttgctgaatttgttaattattctgtttttatagaatcgctataagatcatgtcattggtgaaaaaatataattttactccctatccaatgtggatgccttttattttcttgtctaattgctctggctaggactttcagtactatcttgaatagaagtggcaaaagcgggtatctttgccctgttgctgatctttggggaaaagctttcagtcgttcaccattgagtgtgatgttggctgtgggtttttcatgtatgggctttatcatattgaggaagtgtctttctgttcctcgtttatttagtatttttatcatgaaaaggtgttgaattttgtcaagtgctttttctgtatcaattgagatgatcatgtgttttttccccttctttctaatgtggtgtattacattgatttcaatgtatacattttttcttttttctttttttattgagatagggtctcgctccatcactcagcctggacacagctcgctgcagcctcaattcctgggctcaagtgatcctaccccctcggcctcccgagcagctgggacaacaggtgtgtgccaccacattggcacttttttctttttctgtagagacagggtctccctatgttgcccaggctggtcccaaacccctgggctcaagcaatcctcccaccttggcctcccaaagtactgggattataggtgtgagccaccacacccggcttcaatgtatatatttttaaatgattttaggccatgtgtggtggcttatgcatgtaatcccagcactttgggaggctagggtgggaggattgattgaacccaggaattcgagactagactggacaacatagggagagcccatctctaaaacaaaacaaattttaaaattagctgggcatggtgttgtgcacctgtggccccagctactcaggacgctgaggcagaaggattgcttgagtccgggaggtttggggcttcagtgagctatgattgtgccactgcactccagcctgtgcaagagtgagaccctgtctcaaattaaaaaaaaaaaaatgtggaactgaatcctttcgtatccatcagaggccccagtttcattcccagaaaggagtctccttcctgccctgctggtggggctgcaccctacttgactcctttggatacttcagacaccctaccatcttagccagggcagggaggtggctgggcacccaagcctggtgaccctggggctgtttgcgcttcaccccttagaaaccagtgttctctttgtgggtttccttccattctttagttttgttttaattaaaaaacaatttttttaaaggcagggtctctgttgcccaggctgagtacagtggcacgatcatagctcactgcagccccaaactcctgggctcaagtgattctcctgcctcagcctcctgagtagtggggaccacaggtgtgtaccaccatgtctggctaactttttaaatttttgtagaggtggaactcactccattcttttttattttttttaattgaggtaagacttaagtctcaggtacgaacaacaacaaaattgaggtaagatttactacaatggaaggcacggatcttttatatttttaaaaaatgttatcaggcagcctcccaaaccagaataggtttggagagactcccagaatgcacagatcttaacagcagggtttcatgacttttgtatgtgcagaccactgccacatacgagtaagctacggaacactcctttccctgaaagcacccacaggcccgttcctcacaggcaccgttctgatttctactccatccctttattttgctcactctggaacttctcacaaatggaatgctacagtatagactcttgagtctggccttttccagtcaatacagcatttgcaagattcatcaatgttgcggtcacatgtgtctcatttgtttttttgtttttgtttttcttaagcacagtgtgatagtaaatctcatttgttctgagtgctgtgtagcatctcattgcatgactacagtttgtctgtccattctctctgtctctttaattttttgtagagatggggtcttgcttgttgccaaggccagtctcgaactcctggtctcaagtgatttgcgcgcctcggcctcccaaagtgctgggactacaagtgtgatccactgtgccaggcccctgttctcttattgatggacattcttgtgatttctggtttggaaccattatgaataaagctgctctcagcattcttgaacaagttctttttgttcacctaaggtttcattacttctgggtaaatatctaagagtggacttgctggatcatagggtaggtgcatatatttaactttatttatttgtttattttattttgagacagagtctgtagcccaagctgaagtgcagtggcacaatctcagcccactgcaacctctgccttctgggttcaagcaattctcctgccccagcctcttgagtagctgggattacaggcatctgccaccatgaccggctactttttgtatttttagtagagctgggggtttcaccatgttggccaggctggtctcgaactcctgacctcaggtgatccacccaccttggcctccctaagtgctgggattacaggcatgaaccaccacgcctggccaatacatttaactcaactttatatgaaactgccctctaggcgcagtggctcatgcctgtaatcccagcactttgggaggccaaggccgggcagttcacgaggtcaagagatcgagaccatcctggcgaacatggtgaaaccctgtctctatttaaaaatataaaaattagctgggcatcgtggcacacgcctgtagtcccagctactcgggaggctgaggcaggagaatcgcttgaacccgggaggtggaggttgcagtgagccgagatcgcaccactgcactccaacctgggtgagagagtgaaactccatctcaaaaaaaaaaaaaagaagaaactgccaagagcgtttcacagtagctgaaactcatctttcctgcagcattgtatgtgcattccagttgtcagttgttccacatcctcaccacacttgctattgtcaatcttttacattttaatcattctggcgggaatggagtggtatctcattgtagttttgatttgcattttcctggtaactaatgatgtccatgattttatgtggttgtttttcaccttctattaatttgcaagagccttggggggtgttttgttttgttttgttttgttttgttttgtttgttgtgtctcgctgtgtctcccaggctggagtgcaggggcgcaatctccagtcactgcaacctccgcctcccaggttcaggtgattctcctgcctcagtctcctgagtagcttggattacaagtgtgcgccaccacacccggctaattttttagtaaagacggggtttcaccatgttggccaggttgctctcgaactcctgacttcaagtgatccacccatctcagcctccccaaagtgctgggattacaggtgtaggccactgtgcccggccaagagtttttgcatatattctgaataaaagtctttgtcagatataaatattgcaaacactctttcctaatctgtcacttgcctactcgctttcttgatgtgcccttttgaagagcaaaacttttacatttggatgcctgtgctttttgtgccctaagaagctttgctacctgaacgttatgaaggttttcttctgtttagttttggaagttctattattttcacttctacatgcaggtctgtggtgtattttgcattgattttcatgtgtgatgtgagtcaaagtttgttttctccttatggacatcccattgttttagcaccattaattaaaaggactgtcgtcttctccattgaatcaccttggcactcttgttaaaatccaggtactacatttgtgcggatctacttccggacccctattgtgttccactgatttttgtcctcaggcccaaagcataccgtattcattattgtagctggccaggcacaatgctcacgactgtaatctttgggaggccaaggtgggagaatcacttaaggccaggaatttgagaccatcctgggcaacatagcaagactctgtctctataaacaaaatgatagctttatagtaacacttgaaattagatagtgtaagtcctccaactctgttttcctttttcaaaattgttttggccattctagttcttctgcacatacatgtaaactttgtaatcaatctgtgaatttctataaaaataatcagcctgacaattgctcatgggattttgattaagattttgttgaatctataaatttggggacatagaacatcttaaaaatatctcatctttcaatccttgaacagattacatctcttcattgatttaggtcttcattaatttcttttcttttttctttttttttttttttgagacagggtctcactctgttgcccaggccggagtgcagtagcacaatctcggcttactgcaacctccacttcacaggctcaaacgatcctcctgcctcagcctcccaagtagctgggactacaggcatgtgtcaccatgcctggctaatttttgtatttttaatagagatgggtcttaccatgttgtccaggctggtcttgaactcctggactcaagtgatctgcttgtctcggcctcccgaagtgctgggattacaggcatgagccaccgtgcccgaccttaggtcttcattaatttctttcaggaatgtttatagttggcagtgcataggtttgggcatgttttattaaatttatccctacacattttatgttttttgatgctactgtaaatggtacttttaaccaccacatgtcctcactcatatgtggaaggtaaaaaaaatgatctcacattagtcaaaagtaaaacagaggctattagagctgggggaagggagggagagagagagacgtgttgaaggatacaaaattccagctagatgggaggaatacattctagtgttctacaccactgtaggatgactgcagttaacaaaaatgtatagtttcaaatagctaggaggaggatagcaaatgttccctaacgcaaagaaatgataagcgctagagatgatggataagctagttgaccggcatctaatcaccacacattgtatgtattgaaacatcactatgtaccccatgggtatgtgtcattatttgtccatttaaattgttttaaatttcactttctggttgttcatagctaatatataaaagtagatttgacattttcccttgagttcctgctaaattcacgtattaggtctagtagttgtcttatagattccttaggagtttccatgtccatgatcgtgtcatctacaattaaaaacaattgcgcttttctttcatatatatatgttcatttgtatatgacatttgcatattgatttacctataatgtacatatgatgtgtacacatatgcatacatatctatacaggatttttttgcctatgtcagtggccaggtccgtcagtgacaatgttcagtgaaagtggtgtgagtgggcgtccttgacgtgttcctgattttaagaaagcgtttggtctttcacaattaagtacagcgtaagctgtagatgtttctcctaaatgcctttttatcaggttgagtgagtttccttttcattttagttcctagagagttttattttttcgtaaatgggtgttgaattcggtcaaatgctctttctctgttgatatgatcacggtattattctttgtcattctgttaatgtgataaattacgttgattaaatgttggctgtgaaattgtcttgcattcctgggataaattccatgtggtcataatgaatgctttgtacgtgttgctaagtacaatttgttcacattttgttaaggacttttgcgtctgtattcttgagggatgatgctggcctcataaaatgagtttggaggtgcttctcccttctctattttcctaaataattggtgtaatattggcattatctcttccttaaatgtttgatcaaattaaccaatgaaaccatctgggcctggagttttctttatgggatagaatttaattattttaatagatatagagctactcatattttctgctgcttcttgtgtaaattaaggaatctgtctagttcatctaaattttcaaatttagtgaactaaatttgttcatattgatttattctccttttaatgccagtagtctctgtagcagtatttcctctttcatctttgatataggtaattttatggctttttattttcaaataaccaacattttaccttactggttttctccattatttgtttcctattttattgatttccacttttatgtttatttccatccttctatttactttggttttaatttgaacttctttttctgttttttgtgttttgtgtttttttttttttttttttttgagacagagtctcactctgtcgccccggctggagtgcagtggcgcattctcggctcactgcaagctctgcctccggggttcatgccattctcctgcctcagcctcccaagtagctgggactacaggcaccaccaccacgcccagctaattttttctgtatttttagtagagatggggtttcaccgtgttagtcaggatggtctcgatctcctgaccttgtgatctgcctgcctcggcctcccaaagtcctggaattataggcatgagccactgcgcccggccctttttctggtttcttaaggaggttgcttagggcatagattgtaaacctttcttcttttttaacataagtatttaaagctataaatttccctccaaccactgccttagctacgttctagaaatattgatgtgttattttttcattgtcatttaattcaaaatattttccaatttctcttatgagttcgtctttgattcttaagttatttagaatgtgttgtataatttcccagttgggagcattgccaagctatctttttatgattgatatttattattgttgttatgtcctagtgtatggtctacttggtgaaagttccatgtgcaactgaaaagaatatgaagtgtgaaacgtatgtgaagaatgatggtgggactctggtataatcatcttggaaaaagtatttgtcattcttgtgttaaacatatacctacctatgacctagccatttcactcgtagatgttcatccaagagaactgaaaatgtatgtctacacagaaagttttacattaacattcattgtagcttcatttgtaatagccaaaaacaacccaccagtaggtgagtggataaacaaaattggcgtatctatacaatggaccaccacttaccaaaaaaaacaaaaaagaaaaaaaaaacagctcctgatactggctttttagatgtacctctttgtattttagtggttgctctagaagtttacattgtacatctttattataacctacttactgtatatctttattataacctacttactacctacaccttatatgtactacttcccattaagtgtaagaaccttgcatctgtataattaattccattggcaaccatgtttttgctattgctgtcatatgtttttcattaatataaacccaaatatacattgttataattcttaagtaatcagtattgtttaaagaaaataagagaaggaaaaatacggtatttttctttacctgtatattcccacttcctgtacccttcatttcggtctgtccatctaagtttccatctgggaaaatttcccttctgcctgcagaactttttactgcagtttttgtagtgcaggtctgctggtaaggagtgatcttggctgactttatctgaaatgcctttatgtctgtttagggtttgaaaagtagttcactgcacatagatcttggagttgccttcttttttttttttttttttttttttaagacggggtttcaccatgttggccaggctggtctcaaactcctgacctcaagcgatccgcccacctcggcctcccagagggctgggattacaggtgtgagccactgtgcctggcccggagttggctttttcttctttctgcccatacacttttttctgatgggaagttgccaggcgtgtacaacatgtcccggctgctttcaaggttttctcttaatcttggggtgtccaagagtttgactgtgataggcctggctgtgtttctttatccttatattgcttggagtttgctgtgattctttgatgtttgtcaacaaattcatgaaactttaggtcattgtttcttcagtttttttttcctgcctcattctctctcctctcctgagacatcaggatgtgagttgttttaatattgtcgctcaggtccctaaggctgttttttcattgttctttttaatcttgttactctctatacttttgattggagaactttttaaaaatctctcttcaagttcattgacccttacttctgccatctccaatctcttcttaagaatacagtccatccagttaaatgtccaattttcacttgttatttttacctttactttttgtcctagaattttcctttcttttttctttgagatggggtctccctgtgttgcccaggctggaggtcatgcatgcagtggtgtgatcatagctcactgcagcctcgaactcctgggttcaagtgttcctcccacctcagcctcctgagtagctttcaagagtgagccactgcgccctgtcaaccatggacacttaaaaacagaaaacatagcataaagccttcatgccatgctttacagccatgctttgagcacctactatgtggcaggtaccatgctggggacaaaaatgtgaagaagggaggcccctgcagggcaagagagaaagacaggctttagagtaatcaagaaacagcattctgtgggagccctaagcgggtgcctcatcttgccagctgacagggaggactcctggaggggagcctgtgtgttgaatcttaaccaatgagggggcattagccagggcagaaagaggaaggcacagctttgggctgagggaacagcatgggcaaaggcacagaggccagacaaggcgggtgcagaagaaagtcccaggcaggagtaaaggcagtgtccccacccactgggggcccccaccgtggtggctgtctggtcctcacggcggccctccgcgggtggggtgggatcagagcttgtctgagctggtgaaggcgggactcatccctgctgtgtctgggcctcctggtgcggtcttccgccctgacatgcctgggcacctgggagctgacaggtacagcacctttccagagatgtaaggcactggatgggagactctgatctgtaaagaactggctgatgggaagcgcctgctgcattgatatggcatctccgccccaccgaggctttgaaaatcaaatactccccaagctatggaaacccaaccacaggcggactgttaggactttattattataatcactcggcccaattccagccaccgcgggcagaacaatgagccattgaatccttgcagaggtctcgcctctcccatgggcagggacccggtgctgaggccttggcagggagggtggtggcaggcctgtgcgctactgcacagcccgggggcccgtggggggtctgggcttcggtctcctcactcatcgagcaggaggcctgaagagaacacatccggatggtgctgcactctcctgacattctgtcccacattgtgacccttgtaggtcaggaactaactctgcttcagggagaccatgatgcagaagacaccagcgtccttcgcagtcctcagcatgcatggcctcgcctatataatcacaaaaagggagcctgtggggtgttcccgccccaagctggggtgcctagtataggggtggccctgggagtcccagctgggtcagaggccagcagccagggtagagggctgggcacagttggctgcacccccagctgctgagttacaaggccacaccacctcctgccggtggctccactttattctcaagcatttggtgttatttgatcaccagttataagccaaaaagattccagttttaattaggggggaaaagttccattctgtggaaccgcaaggccccatgattgtcccacgaaaccctagaggccaggacctcgccaggcttgagccaggtctgccctgcccttcggtcctgcttcaccggcaccgctggctttgcatctccatgtcctgaacacacttgggtttgttgggcctggattttcactcctgtgggtgcccagccctctgccctgcccctgtgagagtcagctaccaaccaaaaggcacagcgggggaagttctcttctgtctccaaagagtctctgcttgtccccctcactgggaagtaagggaaggctctgggaacgccagcttgggttttgggattagggtaacctgagcaccgtacaccatgtcagggctgggatcaggcaggctcgggcctaagatgctttgctgggccccacagacggccccctcgctgtcctcataggcacacaggattggctgggggccaggacaagcagggctccagaaccctctggcggcaggaccagaggtcagggagatttgagggagttaggccacgcctcgagagcaggcataggggaagatgagggacagaagggtggtcagggtgcggcaggagtgaggctcggctgcatctgcaggacagcaccaagggcccacgggcaccaggcccaggtctgaagctgcagccctgacggttcccatgatcaagtgtgcagggattaaggagcagtatctggaaaatgggcccacagtcttgcctctctctcccagggttgcccagaagacccatccagggtgttgacagcagcaatcactggcatttagtgcatggacttggccgcagggcgtaggcaccgtgtgggttgtcgtcctccactcctggccagtgcaggcagtctcggctgctgtcgcctgtattccctgacgacccgtagtgccagcccgagctggatgctgtcaccgcctgacggagcgcagggtgtctgtggcaagtcctcaactcttggccaaacttcaccctgcatggtggattctgggaacagaaatcgatgatgccagccacgcctgccgggcttggaggtgggccctgtggctgacgctcagggggctgctgcaggtgaggcccaaggagcgcccaggtgtccggggtcccatccctcccacactctgcctcccagaaccccgtcggggctgcatcacatccatttcctgggttatcagtctcgtggcagctcttgcctgttgaagaatcttctgtccagctatttcccaagctgaacattccaggttgtggctggacaggcccttgcccgcctgcccccaaccctgagctccttccttcactagcccaccagcagctcggctccctgcagccggccccgtgggacctggtctgggcaggggcacagcagagctgggatctgcacagcactggagcactggatcctgcctggaagagcacagcccagaagccccaagcacaggggggaggcccctcagcccgggcgcagagggacatgggagcacacggagccagttcctccctgcctgccttctgctcggggtggcagccaggacgccagcgtgtacctctttatgcccctgcctggtccaggaagaacctcaggcagcttgcagggccatgcagtgcccagccagagagcccagctcgaagatggtggtagaggaaggagaccaggctgggcataggatgctcccgtgccaggctctgttgagctctgggcttccgctgggagggctggggaggggagggccagggagacagaggtgggctagcccaaggacgcagcctgggggcccatgggaggggtcttgtgggccagtggccctaccaggacgggcgtggggctgctgcctagggctccatggaagcccagggagtgggatctggaagtctctctcagcagctggctggctctctggcctggccaagcaggcaaaagtaggggccaaggtgctgggtggatgggctgcggggtccctggtggcatgggggcccacgtccaggccctgctagagcagtcccaggtggggggtagctgggttgtggagagggacaccaccccagcacactcccattctagtcttcgccccatgtgagttgggctgaggcccccacatgggctgggaggtccacagcctgtgcatttggggccaggagagggcatcttcctctactgcccaagagtaagacctggcccaggcccatctggatggagaggcagttcagagggagatgcttcctgatggggcgccctgtgcctgggccttaatacctgtaggggctgcaccacctgccctggccactgatgctggcccgctggccttgggtgtagaccccctgctgcttcctgctccagagggtggggatccccgtgtctggcaatgaatgacccacaccaaccctcctggaccctgactaggcccaagggtgggaagtggcgatgagtgagggcaggtgggcagaggccagcaggtctcatcaggctgggcgggaggatctcttgcccaggacaggggcactcagggaccctggggaggagaagtggctcccagagggacacggggtggggcagcagcctgggaccgagaccaggaggctcaggtggctctgagctctgggaggcaggagtggcccccacccaccagcccaacgcagacaccaacacgcttctcatgccacccactgaagccaggtgccaacctgtgctctcttggggagggatgtgagcatggggcggtgacgccactaggatggagcctcaacccgaggtggcccaggcacctggagcctcaatagggcctggaggggttagtgtggcctcatggccctgccccgatgagcacactgcccagccacctcagggcatccctcattaaaggtcttgggtcacctccagttcttgcccagtgtgtgaggggtaggtgggggcctcaggcctgcctctgggtcctgcttcaacctggggaggggaccagggcccagtgcccaggcactggcggcacctccaagctgctgcactggggctggagtggccgtgggccaggtaaggcaagcaggtgtcagccgaggtgagctcatgtgccaagaccctgtgggaggagcccaaacccgaggccaggaaacaggtgctctcaactgcagccccaccaaactgcagccccacctgacgctgctgctctcacaggggcagccctgcctgagggcctagccagcactaaggtcacctcacggccaggagagcagggccgaggtgcccgatggctgccaagtgaggctagggccaagcaagggtgcagcatgctcagggagggggctgcagtctgagcatctcagttacccctccccttgagctgatgacccctgctgtaccccctgtccactcctcagagccctgccaggccctgccctcccctgctgccccgctgtggccctcgaagccctccataactgtgtgtcccctcccctgcatgtggaccacccagggggcctggggaactgcccaatgtcactcaggggtgttgggggcaggagagggtgacactgccccatgcagggtgtggcagagaggggccactcagcctcgctgggcagcaccccccgcccacttctcctgctcccacgtctttgcgagatccggtgccacagcagaagtgtggaggatgtcgccgggggtaattgcaggttacacagaacaatctgaggaattaaagtcatatttttattgcaccataaaaacatgtgaaggcggcaggacggcggccgcggggccaggcggagagcacccggctctggccccaccctgcactccctgggccgtctccagggagacgcaggatcgaaaccactgttggcccagcacaccggtcccacgctgggcaagggagaccgggagagcggccgctttgcccacattgccctgctgggccctggttcctgccctggctgtgcagctgcctgggtgggggctctgggccagtgtcccaccagagtagtgaggtgtggggatggcctgtgcctgcggggtcccctgggcctggtctgcagccaggtgcctgccagttcagcaccggccctgagagggcctggggcagcagtgctggcctctttgtggccactcttcacctgcagcacccattgcttgtaaactgggctggacccctgcctaccacttaccaggagggtatgagcccctgtgcagcaggagcccaaggacccacggctgcctgggatgtgtgtggtggatgttttggtccctcctaggggatgtgcaggccggctgaatgggccacacagcgtgggagagccgaggtcacagagagcaggtgtgtggtacacggtgtgttctgggaagaaggggcacgcagagaaaaccacctggaggggccagtggggacatggacgtgtgggtggctctcaggccaccagcaacaggtactcctggtcggctgggcagacagggaggcaagaggccctcccggcagaatgcggcccagtgtgtagtgcgggctccacacagctgcatcctctccatcaccacaaaagcaccaaggccatttcaagctttccccatgctccctggcaggggctgatcccagggccaaggaatccacaggccctctgcccccttcctggctgctgcccagagccaccccccagagcccaggcagcaggtgtaggctgacctcccagcctggcggtgcctccacggcaaaaaaaacttgcaggcctagaggcgagccccacccacaggatccggcccaggcatgccaccagccgtgtgttaaatgggacacggctgatctagagctgcacttgtgggagggcctggcccagcacttggcatcttaagtgggcgtctgagagctcacgcgcacgtttcacacagcaagtcgggctcctgcaggcccattaaggtgcaaaggcattcctctgtgtgctgacaagcagggtcccatccacggctccgggccggcagactaagtgatgttttcttaaggaagacacgcgattagccacagctaaagccccagcacaatgcagggcccggccatggctgtcagcgctgtctctcggcagtgactgacaggcactccccagcccatcaagcctcaatgcacaggattagcctgacgcagccgacaagctgacttggagggccacggtggaaaaccggcaaagtgactgacatccggggacagagagcctcacacagccctgctacctcctgtcatgggcctgcctgctggcgggctgttccagaacaaagccggtgttgccgcccctcccaagagcctccctggcactgggctgcccttcttgcttcaaggtgcagagacctaggcagagggtcccaggaaaaaccctcagtgggcgtcttcaggccagaggccaggcagctgtggggcaggtggggcggctccgcctcctgcctaagtggggtccctagcactgcaagtctgctcccctctgcccagggctgcttggaattgtgctcgggggttcaaggggccccagcggactctgggctgccctggatggaagctactcacgattgaagaggggcctggtggcctggccagaccccacccacctgggcgatcctgggggaccatcagggacaccgcaggcagagcacacttcagaaaaagtaccctctttatttgcattgcagaaatgccagggggctcggacatgggtgcccacagggtaggtttccacccaggtcgtcatcatctggcaccaggagcctgggggggggtgcccggcggcagaggctgagaggtgcaggggtgaggtggacagtcccctgagccatccctgtggggcacacgggccacctgtccagcacttgcgctccacgctgaccatctcacaggcgctccaggagagggttgaggccccccaaacctggcctgcagccatcctgccaacaacaggaaggtcagcacaggtcagccacccacccctcacatcagcctagctatgtctcccactgccacacccagggacccccaagggagatgggtgagaaataaacccagcagagaatggccccaccccagggcgatgcgtcacagggagcgacgcggtgctacaaaaatattttgaaatgataaaaatttatagcaggctcctaacaaaacagctctgggaggtgtaatgttctgataagagtttcctcaggatgccctttgtttatccctatcgagcgcggccccgccggggggaggcggccacggtgaagcagggggccctgagtacccccagagaggcctccccagagcccctcggcgccatgcagaccctagagcctgtccacaggcatcttggggggagcccactgctctgcctggtctccacctcagccccgggggagagatggagcccaaacaccccaaccctgggaggggctgacagccatgggggtgccccaggtgggctggatggcacgggctgagggcccaccctgccccggcccctgccctgcagcccaggccggaggatgcactattagaccacgaggcgagggggctctggcacaggcatccctggggcagaggccaggagcccttgccagtttcttcctccccagaagaggtcacgatgaacaacatgccccccggtcagcctggctctgcagagctggaacagaaccagatgtgcagggcaggctgggcagggccggccatcacagggcagcgtctccaccttctgggagatagggaaatgagcgggcgctgaactctgcaggagccaggccttggtgggaggcctcggtgggaggccagcttcccgactgcagccccctgtggggcagcaacttgagatgcccgactttagcccacccgggacaccttccacgccaacatccacctgggataggctgctaaggatgagccccgtttcttgatacctcctgtgtgtggggagcagctgtggccaggccggggtctggggtcccccggggaggtttgggcccctgggaacttccccttctgcctgtcaccgctgtggcctggttacaggatggagcacccattctgggtggcgtggcaggtgtagccttgctgtacacctggagggagcccatggccagggctcctgcacccctgccacatgccctgtcctcaaacagagccagccccacctgcatacctgggtctggcctccgaggagctggcggcgggcgcaccgtgtgccctggcctgcagggatggcgcttaccctcagcagcctgtcaccgtggggtccaggcctgagcgcttggagatgcgcagcttgactacctcctcagagcatgtgggatggatacccacggtccgcatcacctgcgcataggaagccccacacctgcacatgggggatgggggaggcaggcggggtcagcacagggaggggggtccacagcatcccacccccgggaagaggagggcctcagaggctgctggtctcctcactgtcccctgacccccagccagcagccaggacccctgcccacacccgtgggtgccatccacctccctcccagcagatgcctagtgctcgtccagcccacctcccacccagccacgccctggcttgccctggcctggcttcctgctgttccatcctcccctgctaggcacagtcctgccttaggcctctgctctctgctttacccacagacagcgcatcctggcctcaccacaccaccacctcccaggccccacatccagccagccacctctctcaggccatgcacaatgtcccaacctccaactacccctgtcaacccacccagagcctttgccatggcttcctttgaccccgggaccccgaaaacacacagcctgagcccaagacccaggcaatggccccagctccagaagacacacagcagccctggggtggctctccaggtactggcactctgctcatggtggcgtggtgcttggccaggtgggcaagggccctagcagcgacccggggccacaggggacacctcacctggctctggctggctcaacagcgtctggctggggcagaaccgcctcttgtccccctaaaacccgccctgtctgaggggcctgaggaatctctgctgcaaacccacgaaggccacataaatgccgcaagagtggcagcagctctccactgtaggactgccggcactcgagggatacccagctgcacatcgcatcgcagcctgcattcctcgggacttacttgatccccagagcaaatccttgagtaacttcgcctgcgttggggccaaggaaatgcaggcccagcaccagctgtgggggctccctcaggcacaccatctgaaagccgcacatctcagccaccagcccaggagggggctgggttgcgtccaccctgcatccaccctgcaccctgcctgggaggcatgggtggggccagtcctcgggtgttcaccctgccaggctctttgccaccctccctctcatcctcagcaccctgggccacagggatgctcacctttacataacactgggatgcatctcgtccagccaccgtgaactccagtggtttataatgggcgtgatagacctgaggacaggataccaaccctggatcagtgctgcgacaaacaaacctcgtggcacctgcagctcccacaggctgcatgggcaaggcagggtcatggcgggcaggaaccatccatctggcctgaaggtctggtctgggatggggatgagggcttggctggccacggggtgtgtgcaggccctctcacgtgcaggcagccagtggctggagccatgctctgcaggacagaccctgtcccacccaggcctgggacccccgtaaaccacagcagcagagcaggcatcaggcaatccaagcagccaggccaggcacagcaaacctgggtggacgtagctcacccacaacaaatggtggaggcaagaatgggtgagcaggaggccacctgggctccctcaggcaccctggtgtttgcttggccctcactggagcaaggccgctgtggccacaccggagccggagctgttggacaaaggctttcagcacccctgaagggctcgacagcgtgtccggggctgcggccaagtaaaaaatgagtggggccctcacatgtgctgtacagccattattaattaatggaacttcagagaatattgttctaactaagacagaattgaaaagaaaacaaacagagtatttggccattcaacattgtgaaacataaaacaacattataaaatgccaggaacatatgtcccagcacacttgtgatgaatcaaacaaaaatagcaaataaagtgcctcggggaaggctggcctgtcaggcccgtcctgttgatggagagttctggggtgcagggggaaggggccagccctggagcccagtgtctcatccccaaaggccgcaggccccaccgcccaggctgcaggctccggtttctctgggtgcctgcaagctgcagcggcagcaagatgaaaccgcaccgaaggcttccagctaccacggcccggcaggcttcagagcccccgcatccctccaggccaccccggagccacagccacctgccagagcagacccccaaagcaggcttgctcgatgaaaacccctttcctcaagggtgagtgcctgagcctggaagaagctggaagaggatgggtatcaggatgtggtggggggcggggggcggggggctctcgcctgggagaaaccctgggcagtccaggaagacgaggtgcagggtggtggggggggtgggggtggaagcagaggtcggaggcccctgggagaaacttttctgggtagagtgagattcatggccctgcaaggtggggacagcacagaggcatcttcggggccctggtgctttcagggacaagctgctgtgtgctggagtggggccagtgctcagctgacctcagcaggggagcgggtggcaccgtggtggtgaccctgctggtgctgggcacccctgcagcatggctggggtggggctgggggcttctgggccacagggcttctccttgccctcagaacaaggcagccaagggccttcccctcactgctgtgacacatggtggcagagaccagaggcacctaagcccagtcaccccaaggctgccaaagcccaggcacccccacttctgaggctgcccccaacgtgtcccttcccgctacacacagccactgctcagggcccctggaaaggagagaccttggcaccctgctcacaaggcctccgcccagagcatggggtgaggtcgtggagtcgccactgtcctcagctgtgctgctcccaggcctcacctcaacatgctcctgcccgtggcgagccactgcctcctcctcggacagccccacacagccatactccagcggggtgaagacggtcgtgggaacctgaaagcaggtctggagtcagggagggcccttgggccccgaaaaccgaagttccccactgcatgtgacacaaagagcagcgatcacagaccaggaccagatgcgcccagagcaggctgcaagcacagtaggcgacccacctgcccacgcctgcgccacactctcagaactgagccacacacccatgcatgcacacacacgtgtgtacaacacacccacataagcgcacacacacgcatgcccacatctacatgcagacacacagcgcacaaaggcccctcaccccagaagagctagcctcgaactcagcctgtcctaggctgcacgtggcgtcctgctagagaactcacattgtcgtagtccatcagatctgaggacccgccgaagagccgctgcaccaggagcctcccggccatgatcgctatgggtgtcagctcaggccgccccttggggaaggcacaggggggccacgtcagcaccatgtccggggttatatgcagcccctatgccatcaccctttgccctccgagtgggcatctccctttagaaaatccccaacactggcaccgagcatggtgacgtacagcattccccctagagctcgtcctcctgaggggcatcccaaggacctaggtaggttgctcattctcctgtttgctgccctccactctgccctgggaaaggagtccgctgctgatgaggctggccgtgccaccctcacatgctcaagccttctctccaaaccccttctgcacattgctgacctcggagggctgccccatgaccaagctcaaaagagcccctgctaccgttttcattcactggaatccccggctaaaaagggaccccaaagcgttccatgtgctcctgacgtgcagcttgatctgcacgtcacagtccataacaaattccaaatcagaatgtcgctgtgctggagatccctccgtcccagggtgtgcccagccttgggggttccagcaccgtcctctgggatgggctgccaatcaccatggcagcaggaaatgcagatgttgtttggcattccagaaatgcatagagatccgtggagataaactcagagcgcagcctgcgcattccagcaggcctgactaactacggaaacatcccggcgggcggcgcacagcacacaacatctcattaaacaatagcccccgccccgcccacaggctcttcccagccgctcaagggaccactggttgggtgttaactctttggactattcagaacgacctttctgacagagtggatttaatgtttaaataaagaatgcctttgtgtgcgccatgcatttctggcaaaacggtttgaaatgttccagtttccaacacaggagcctgggagctacacacttgcagagggaaaactcagattcccagacagaagggaggcttcccgctgtgcacagagatgcacatggcactgtctcagggtgcagcgcccacaggattcaacagaccctgcaaccagagaccactgcacctacatggtccacaggcagaggctgcgcttgcagaaatcactgagcagctgaaccatccagctaagcaagctggggctgcagggtggctgaggcacatggagccacatgctctgtccacacaatcgggtcggctagatgggccctacaggaccctgcagggtctgcctggagcctcagagtgtgaccttatttggaaataagatctttgcagatacaattaaggtaaggatggaaatgaagtcatcctggattagggtggaccctaagtccaattgcagagaaactgtaagaggcaaatcagggcccagagacacacccaggagactgtcacatgacgatgaggcagagagaggagtgatatagccacaacccgagggacgcctggggcatcctaccccagaggcttccgagggagcctggcccagctgacactttctgacatggagtctcgctctgtcacccaggctggagtgcagtggcacaatcttggctcacggtaacctccgccttcctcctcccgagttcaaatgattctcctgcctcagcctcccgggtagctgggattacagatacgtgccaccacgcctggctaatttttgtatttttttagtagagacggtttcaccatgttggctaggctggtcttgaactcctgacctcaagtaatctgcctgcctcggagtcccaaagtgctgggattacaagcatgagacactgcacccagccccagctgacactttcatttcagactactgccccccaaacgtgagataatccatgtctgttgttctgggccacccgtgtgtggtgatttggtaccacagccccaggacgcagacactgacaggtctcgctacaaagaagctctcagcgaccctccagagccactttcagcagcaggtgctggacacatgcaggacaggccgagcactcctgaggctgccagggtgcagtatcccaagactgaccaccacagtcccttactggggccatgtgtaaggagggctccagagcccccacccaggaaagactggcaccggtctccacttcacagcagcagcagcagctgagagcaaaggacctgccccggtgtgatgcccagagaggcaagccagaggatactgaggcggggagggcggggccaggtgggcccgaactagacctgcctctcaaccctgtggggacaggacggccccaaggccatggtggcatttctaagcctatgcctctagcctacctgccaggggttgaggcctgcgtgcagagctgacccatgccccattcccagcaggcgtctgctgctggtgcttgcagctgtctttagaccatccacactcccaccacagaaaggaaaggaaaggcagagagccgaggcccatgtccaggttgccccagaactccagacaggctggccctggggtttggcccagagcctctgtcatcagagaaagtgtcgtttctctcctacaggacggcagcagccggagcccagcgagcaggggtggtggagcaggcaggggcaggggccctggtcccgggacgcatgccgtacctccaccacgtcaccaatggcgtagatgtggggcacagaggtggcttcccgggagtccaccaggatcttctgagtgtcggggctagtatctaccccagccttctccaaattcagacttctggtgtctgggactcgacctgaaggaaacagagagggggctgaaaggttatcttcagtggctttgacctagagcggttgtgtttaaactgtttctcagaatgtccacttagagaccgggtgcagtggctcctgcctgtaatcccagcactgtaggaggacgaggtgggcaaatcacctgaggtcatgagttcgagaccaggctggccaacatgatgaaaccctgtctcagccaggcgtgatggctcatgcctataatcccaacactttgggaggccgaggcaagtggatcacctgaggtctggagttcaaaaccagcctggccaacatggtgaaaccccatctctactaaaaatacaaaattacctaggcgtagtggtgcacacctatagtcccagctactcgggaggttgaatcgcttgaacccaggaggtggaggctgcagtgagctaagattgcaccattgcgctccagcctgcgcaacaagagcaaaactctgtctcaaaaaaaaaaaaagaaagaaaagaaaagaaagaaaccctgtctctattaaaaatacaaaaatagctgggtgtggtggcatgcacccgtaatcccagctacttgggagggtgaggcatgagaattgcttgaacccgggaggtgtcggttgcagtgagccaagatcacaccactgcacttcagcctgggcgacagagtgagactgtctcaagaaaaaagaatgtccacttagaactggccaaatgtgaagcaccagcagcgtagaggggctcctggcctctgcaggaggtggcaggcaggtctgaaacggacactggtcagatgacagccggcacaggagacaaggcaggggtgccaccggtggaaactggagtcggccttagactggttcctggcacgcgggaaaggaagaggcacttgccaatgctggggctccctgacatcaaagagtgctaagcgcgggactccagaatcttccgcatgcccaggcctcaggccctgctgcagggccaccagcacagtgccagtggctctggtactgacttcatccggagaaaccagcccttcatggggagctgttggcacctggcctgcctggcctccctgcatctgtctgcagcaccacagcctgataccattaggcagtgagatccatcagctcccaggcctcaagagtccagaggggcctccttcaagggacacctgctggctcccaatggcctcctccctatctggacaagctgaagaggagccagccacaccctggactgtaccccaacaatgctcaagtcctgggatctggccctctgcccaggtagggcttgaaggtctctccccattaggagaaagcaagcccccgtaacccgctagtagagggccaggtgagcagagctagcagccgggtctcccacctgctctgtgctgcagcccctcgtggctgcctggcacacagtcccagcctagagacctcagggccaaggggagctgagctaaggggcagtgtccaaactacaccgtgcccattctagggggcagctggctcagctgatcctgctcttgggtgcaaaggccaagaggggcaggggatggccagtccagggggtcagcacagctgccccctgccagtctccacacagcctggggcccggagagagggcaccgcatgggcctcttcatagccgaacagccagcagaggtccctttctcccctaactcagatgggtgtgattttgccaggccagcggatggccacagcagcttttccctcccaaccccaggtgctctcggctcccaggggctcaggatgatccaccaatggcgaaggcaattttgcctcaaaagcatagctcccctgctcatcgtggctgggacaaaccagctgctggccggtatgcgggtggcgcccacctaagcatctggaagctgaagctcccgtgagagggaacccttaagtctccagctgctgtcccggggcaggagtcaaaacataccaacttggctaagccagcttgcgggaggccggctccagcctctgtgctctgctcagccgcaggaattgggtgccgggagggctggcaccggtcggggatcagcccagacacaggggatgccagcccacatcagaggaaggagctgggccccatgggcagggctggggcacgaaggaggggctgtggtccctgcaggccgggggctcacgctcagccgtctggtccctctccaacctggtgtccagcccaccaggcccagcacttcctggtgcctgctccgtgccggaacagaacatctgacgctgcacccacactctcctctgcacgcttgcctggctggtcctgggaagccaagagcactcatcatgttcctcatggtaactatggcactatggcaactacagaccttgcaggtgctgaccaaaccctgtccccaggtcccgaaggaaataaagataaatttaaaagtagtcacaagagataaaagaggcatggaaataggtggcccatccaaagccaggactcttccgcacatgctctgtggatcactctgggaagtcggtgggaatgtaatggagccactaatgtgaaaggcatgacagctggacaggctggatggccaggggagagtgggctgcgcggcacagacacgcctggccctgcagggactccacagcccttcgggaatgaacagcaaaagaagagtgagtggcctgtggcaggcagcaggctcagccctgaggagggcagccgagggcacagtggggttagaagctgggctggtgggacgtggctgggagtgggtgcagggaagaggccagctccacttgggtggggccacgtccctagccgtggccagccctgatggcaggacaccaggccctgagccccactatgggtcttgctgagcaaaggactgggcagtggccagagaagggccagatctccctgctggtgctggacagccaatcaggcgtcctaggccctactggctcaggcctggagccctgcaggaggttggacgacttgtgccaaggtggggacccactggggcccgaatgctgtgagcagcaggatgcaggtggctgtgcccagtcagctccccaccatttccctcctatgccaggataaagcagttgtgcctggtcagctcccgaccatttccctcctatgccaggataaatgtgcactattcaggccatttagggaaagaagggtgcctgcaccggtgtctttcgccctgcatgttgtgctcagagctttcccagctgtgcctgtggcccactgcaggcctccccatggggcggctctgtgctccctgcagctccgtcctcgaagccttggctctggagtgcccagtgcagcatttgccaagtgctgctgaatggcccctcctggggtaggacaggcactctcaaggctctgcttcctagacaccaccaggatggagacctggggcaccagcttgccatgtgtcagttgagttcctggggcagaccctcaaaggaagggcggccagctgagtgggggcttctgggcgcagggcagtccttagactctgttccttcctggggcaggcggcgcacagcactctctgtcatgctgctttaatttgcacttctttgatgactagtaagatgaagtaatttttggccacgtgtttatgaactgtatttcctcttttgtaaattaccagttcctgccttttctcatccatttataggcatcttcaccatgttccttctttgtaagagcttattacgtaatggatacatgacactctggcatattttctgcaaacgacaagggcattaaaattccaggtacagctcttcaggctgtattcatgagcagtcgtgggccacgggattcgtgggcagaggaagggcaccagctctgtgttccttgtgcacatgaagcaggagggctcataggcctgcatgctgtggacttagctgagcggcacagctacatcaagggcaccttgaaggacatgcccctgctgagatggtctccaggatccacaccagtttaagcagcagacagagctgtccatcaccaccaagggcctccacacgggccaatttctgtttgtgtactgtagcaagagggcccagctggacgtcggcagcgtcctccctgcaggcaccacacctgtaccatcaagcgctgcctggaggagaggctgagactggaacttgttagcctgggcctttgagaactacaccgcagtcacctcccctagcccggaaaccaggaagacttacatgaagctgccctccaagaggatcatctcagccaacagagctgtggtcaatgtgggagccagaggtggccgaactgaccagccatcctgaaggcaggccatgcccactacatataaggcaaagaagagctgctgaccatggtgcagagtatggccgcaagccccaaggaacgtcccttcagagatggcaaccactggcacgttggcgaacctgccactgcagagatgtctctgctggtagcaaagtgggtctcattgctgcccactggacttggttcagaattggggctgatgggcccaacaaagtttgtccttctgccaaaaaaatagtaattccaggtacaaatggacgtgctcacttcctatgtatatgtgtggctggcccacaacactgacactcaggaagcactgggctgagcatctctgcagcccggagctgcctccagccccaggcccagcagtgcagcacccctgacgcaggacagcccatctccatgtgtggccagtgctaggaacagccgtgcagggcagccctcctctgatcacaatgagagccccaccagctgctgtcaatggcccaggagatggagggcagccaccatgcttgtccagccagcctggccccaaggagggaccagagaaggctgaagcccaaaaaccacccacacagtcaccatgggtcactcccatctattctgatggacacagggacacggggacggccagccgcatgcagtatcatgcgcctctctcatccatgatgggaagaacaggcatgccctctgatttcacgcccgcctgggacacattttcccaagagaagagcaaggaggcagcgccccaggtgagaggtaagtgccagcaggagtacagcagggtgagccagtggctgtgatccagacagaggcagccagggccaagcactgcgcctgaggacgagggtgtgggagtgggaggctccagggccggtgggcgatgcgaggcgggcacggcttcacacacaggccctgtgggccacctggcgactgtctcatgaggcatgtggcccccagagccagccaccctcacggggcctggcctgccacttgccccagtgaggcaccttggaccaggcacagaggagcgtatgcctttggaactggacttagattcttgaagcttattattttaaaatatttatcttctttttttttttttttctggaatcgcaccttctcaatgagccccgggcccctacccgcagctatgagcccaccagggggaaggggacgcacctgccctgctggcctcaggtcccatcgagacgccatgttagttgaataaatgagtgagcccctgggcctcaatgggacctgattggccacttgctgtgactgccagcagccaccagggacccctaggccgttccagggatgtctcatacccagggcggctccttggggggtgggggtgagcttcccctcaggcagcataagggcctttcctactcaagctgcctatgtgcattatgatgtgtaagaccccacagtcagccttggagtacggcgcagcccccagctcaggcccagaggacccccaggaaggagcgtgctctgtggcgagtggtcattattgctttaacagttattattagaccgggtgcagtggctcacgcctgtaatcccaacactttgggaggctgaggcgggcggatcatgacgtcaggagttcgagaccagcctggctaacacagtgaaaccctgtctctactaaaaatacaaaaattagctgggcgcggtggcgggtgcctgtaatcccagctacttggaaggctgaggcaggagaatcgcttgaattcgggaggtggaggttgcggtgagccagatcgcgctcctgcactccaacctgggcaacagagctagacaccgtctcaaaaacaaacaaaaaacaattattattattattattattattaattatttgaaaagaggtttcactctgttgctcaggctggtcttgaactcctgggctcaaatgatcctcccaccttggcattccaaagtgttgggattacaggcatgagccacctcacccggccctttaacaattgttaacataattgcaattgtaacaggttggctgccccagggcacctgcagacattagagggtgcatggtaatatgcataaatggtgctgacctatctctagaagacttttcaccatgttgttcttttttttttaattggtttccactcagttctaatcattaagtactgaatttgtcatggtaacaagacccagttggacaaccatgtatgcaggtgccggctggcctgtcagatagctgtgggctctggacataagtgtgaactagccctcaagccaagcgtggggcaccaggctggtgggtaagcacagggcgctgcctcctgctactctggcctggcctctgtgaggtgttagcaccaccatgagctagggctgagccaacagtgctgtctcaggagcagcagcgcacgcccggggccacgtggtgtggaggggaaggccgcagccaccgctcataggaagagctccatgaatgttcatcttggccccacttcaaaaaatatcaaactcacaatggaggcagatttgggtctctcttgatgtcattaattacaaactaaatttgcactaaaataaaaaggtgttagactatcaaagaggggcctccgatccgtgtcacctgctcagggatggccactccaccctgagagcatggaggcatgtggatgccagggtcactgctgggcccatccccaccgggaagagcatagccacaaacttggtttcacgcagctgcagcaaggcgcatccctgagagcagtcctgatgggcccaccgcagccccctcgcccgggcagcatccacacccaccgcggcccctaagccccagctgcacccacaccagcacagagggcatccaggaggagccgccccttccctctcaccaggcttaggatgctcccacccatccccagcttggttcttgctttctgccctttcctgctgcctggcactcaacagagggacaatccgcagggacttgtgtagctgagtctgcggtgtacgggagccatcagccgagcacagctgagcaaagacagttgcctgccgtgtacatgccagcaaacagtgcctgggtggagagaggagcccagggctgcagcccaccctggcaacagctcccctcctgggcaccgccagcccccatcatcatctcctgggcaccccagtctctctggctgtggtccaggcacacgtgccacgtgggggagactatacaggggcaggctgtgggggtggcctctgtgtggtgccaagaggaagccgggaagccaagctcccatgctccatgcatgttgtgtttcaggctctgatgctggtttacacacaggtggacatctctgagttatctaagataaagcccaaagaggaaatagcttcagtggctggggtaagatccagacggattccttccctgggtctcgtctcacctgccatatcacaaggccccaggcagacctgtggccaccctccctggcactcaggcacaacagctgcctggctgtgggacccccaggtttagcgagtcccctcctgtgtctgctggctcttctggccatgggcaggactcctgtggtgcagggagggatacgccagagccttcagcatctcaccctcaagagagggacagagaaccatccagaggggctggggacgccaaaggggcacatgaagatctcaacttccagtttttcagggctgcagtccagaggcagtctgtcccttctttaaaaccaaatctaaacttaactgcacttagaagcccctgcactgggaggcgtttgctcaggatgccccagcctggccctgctcccctagacagccagggattcaggccacaactggttaactcagcgggcgaattcgagcccgcagcagtgctggctgactgtcttcactcagcgctgtaatcggcacatctgcagacaggaaatcctcctcactgaagttcccagtctattatctgagacacctggtgtgggcgggtgattcagagacaaacaatgagcgggggccccctgcacagcaattaactgctttaactgctaatatgtttaatccaccacgtggagatcaaggctgcgtcgaggaaggggctctggtcctcctctgcttccagactgcagggcccacttcgcaatgccaatgtccatggtcctcgccagctgcggccaggcgccaggcacacgggcaacgggcagggccagcactcggccccacacgggagctctgtgcagcacctgggccccttctgtgtgtgtgtgcaccgggcacggaggcatccccccttcctgtcggagcccagcttgtgcggacgtagtgcacacccggtacaggaagcagagtcggagatgttggcattgccagctgtgccgcccctagggcgctttattttaacctcccagagtggatcatcctttattgcaagtagaaataaagcttggttaaaggcttatcgtacaaaccagcagaaaacgctcgcagttgctgacctgggaagtggctcctgaatgtttacaaaacctggctctgagcagcagcgaagtcagcacatgcccgagcggcccccagcaggcgcgcagaagccgcgccgccctcgggaagcagggtcagaggccaaggactgtgaaaagcttccacccccagcatcaatcatgccaggcagactgtctgggggatgctcattttgaaagtacaaaaaaataaaacagactcctagcaagggaggatgggcgtgcaggccacggcagctctgctgagtagggaggggcctcgcttgttgcctgccaggctgacgccccggctttccggggacacagcccccggcccattggtctgctacatccctatgggcttggtcgagggctgcccctcggttcaatggcaacagctcccttatgctgtgggtgaacggaggtgtcagcagacagaggaggagggctagggcgcggtgggagggagaaactcgccacctcccctttagagtggagtttatttgggaatgacagtaggaggataaattttgaaagaaaaataaagtggagtttaggatgagaaccatcagtacactccagagtccaaaatgttacctaatccttcgtagtgtttatcataataaacttacttaaaatctacttttacaacgtggctgagaacattgctcttgctgactgatcacctccgggccaagagccctgcgtgcgctcaggcatctcaggtcctccccggtcatcacctctgcgcttgtgtccactgcacaaaagtgaagcctcagccgctccaggctggtttcctttctgatttcccattccgagtgactgcttcagaagtgcatcaccctatgacacagcttgtgcctctgggagccctcccccaggagacactgacccctggccagccccacgcaagcccggttagctgatggaggtggaggcaggtgatctgagagggaccctggctctgatcttgggctctcgcaggggacaacggaccaggctcagcacagaaaggcctcggagaactaacaacactgactaggttgctcccgccttcaacatgcaagttgacagggtgattgggaaaactaggagcctaaactagacggccaggcaccgaggtgggtaggacatctgagcaggcatgctgtgtgtgccgccacccaccctgacgaggacccgcagccctccttgcggcggcccatctgcaatggcctcctctgcagcaggcctgggacagagcagtgtctgggcgatccctgttggctccagctgccccttgccagtcccgtcagacagccccggcccaggcctgggcacaggtatcccctggctgtgtccacactccccacacctgctcggccactgccccatgcaaaaccggacctacacctgacagagagcaagaaggtgagaccagactgtgcccagcaagttgtagccagcccacgcctggccgggaaacgcccaggcctctgcccagcactggaagggtgatgtctttggaagccttcgaaatgtgacttctggaaaggcctgcaaaatgccactcctggcatgtgatgacctgccaggcccaaagggacccactgggaaacactgaaagccacgagaaggctggacagaactttaaaaactctgtgtcatttttatgtgctgaaaacaggcggcttgtgcacacccatgttcacagcagcatgatccacaacagccaaaagacggaagcaacctaagtgtccactgacagataatggacacacatacaactcagccttcaacaggaaggaaatgctggcacatgctacacaaatgctaactctaacaaatgctgcaacatggatgcaccctgaaaacattgtgctaagagaaatgagccagtcacaaaaggacaaacactgcatgattctacttacatgaagtccctcgaggagtcagatccatagagacacacagtgaagggtgagtgcccgggcagcagggagtgagtgtttaatggggacagagctcagtttggagataatggaaaagttctagagatggatggtcatgctgcttgtacaatatgaacgtacttaacaccactgaactatatactttaaaatgcttaagatgatgaatttgatgttatgtgtatgtcaccataatttttaaaactttcaaatccatatcatttttatgttaaaaacaacaaactagcttggctgggcacagtagctcaaacctgtaatcccagcacttagaaggctgagatgggaagattgattgagcctgggaggtggaggctgcagtgagctatgatcacaccaccacactcctcctaggcaacagagagagaccctgtttcacacgcaaaaaaagaaaaaaacctagctggaaagcctgaagcagcaaaacatttaatatgctaaagaaaaaatacatactggccaggtgcggtggctcacacctgtaatctcagtactttgggaggccaaggcaggtggatcacaaggtcaggagattgagaccatcctggcctacatggtgaaaccccgtctctactaaaaatacaaaaattagtcaggtgtagtggtgggcgcctgtagccccagctacccaggaggctgaggcaggagaatcgcttgaacccgggaggcggaggttgccactgcactccagcctgggcgacagagcgagactccatctcaaaaaaaaaaaaaaaaagaaaagaaacataccaagacttaaacctggaaggtgacaagtaggatttatgtgctgaaaccttaataagcaattgctcaagggccagggaaggcgaggatgattgcctagttgatcctcgatgaggacacctggctgatgccgtctcagtctcttctctggttttttccagcatgtcccacggtggtggggagacacgcagagatgcaaggtgctggggatggcaagatgggcacagcctagtgtgagtgccgccccacaggccttcacggttgctctcgaggtgcactggggagcggccaacccgcctggcagccagcaggatgggggagccctgggaggtgacaggaagtggggcaaagattctccatgcacctcggggagaccagagacagagcgtgtggctcgacgtgcccttacctatggcccacaggacggtgtcaaaggtgcccgtgtcctccttgccggtggtgctgtcctcccaggtgacctgcagctggccatcagggagcctcctgacccgcgagggggcacagcccctcaggaaccgggtgccatgagatgccatgtgctctatgaccatggaggacatttgctgcaaagcacaagaagacaggccatgaagaccaggtggccgtgggagagaggctctggccctgccctgctctcgaaggcctcaatgaagggcggagaggggtctgtgcggaagacggggtgagacaccctgccccctgctctacgtcctcttgctctctgtggagtgtctagcccctgtcctggctccaagtcctcaaccctgggccctatggtcaggattcactcagcctgtgggctcctctctagatgctaattaactaagtcttcatcagccagatacggtcacacctgtaatcccaaccttttgggaggctgaagtgggagaatccctcaagcccaggagtttgaggctgcaatgaactgtgatcacaccactgcactccagcctgggcgacagagtgagactctatctctaaaagaaaaaataagcaaggccgggtgcgatggctcacacctgtgatcccagcactttgagaagctgaggcgggcggatcacgaggtcaggagatagagatcatcctggctaacacggtgaaacactgtctctactaaaaaacacaaaaaattagccaggcgtggtggcaggtacctgtagttccagctaactgggaggctgaggcaggagaatggcgtgaacccgggaggtggagcttgcagtgagccgagattgtgccactgcactccagcctgggtgacagagtgagactctgtctcaaaccaaaaaaaaagaaagaaaaaaaagaaaaacaaccaaatcctggtacatctacacatttctttaaaaaacaaaaacaaaaaacttagtcttcactaaaaccaatggcagagaagcgtgccttcccccaggagctgtgccctggtccaacaagatggcccctgctcctggcccacccctccacatgtggccaacatgcccctctgccatccaggagccaggagggtaggtaggagactctgctcccgcctagaaatgtaggcacagcaggctcaggtccagatcagggacagagagagtcctgcttctccctcccggcccaggaggcctgtgcgccccaagtccagctacagatgggggccctgttcccaggacaatggggacttgcacggaccagcagtgaagctggccacagcttctggtttcaagaggagaaaaacagtcactgctaacatcctctgacacctgtgcgggtgtgccagctggctctagatggcgtgtgtgggagtctggcccgccgggcagggctggctgtgctgcagaggggctgccgcacaggctgttcatcactcctgcacccctccagaggcctggagggcatggccatcccaggctctgagggagaaccatggagcctgtccaggacacagggtccctcgcccctcagcctggctgcctagactgtgcatcctccttgcctgggcacggcccccattctgcaggcccctttcctcctccgtccactgccagctcaccctccccacatctgaaggctctgaggccttcctagacactgcgtccctaccacagggctcggtgggtttgcactgagggacatgatgggagtgtgccatagctttaggatggaacaacacatggccacacgggtggagggacacgtctctgagtcagcctgggggtggcactgggagtctggagatgacaggcctggctcctcccacctcaggtgacctcctcaggctctgtgagctgagggtcggccgaggacctgtagcagggcctgcagatctgcacagctcaccctgcaaggggcctccttcgtggcagtcatggagtgtttgacatctccacaatgacaactccagacttctattttaacaggagactttcccttgaagagtttttagctaaaaaaagaaaatctctattgctccaatctaggagctcgtcctgctggccacatgagtgtgtgtaccccagacacagatgaaggccactgtacacagcgcacctgtccagaagccaagatcccacgggctgtctcggagccagcgctgccctgtgtccctcaccccagctcacacattacagcttatttcacccccactccctcagaggggacaggcaaggggagagcagggagttgggggtctctgaggtggggctaacacttctgcagcacacaccggcctcttactaatgggacgacccggagggtgacctgctctgccggcacaaggctgggctgagcctcccttcactgtgcctgtggtcggctggaggcctctgtgcagctgtgcgccccactgccaccctcctccctcgctccggccgagtgtctgcatatttcctggacaacctcctcatccaattcaagggttatctctaaagattcaggcatcactcgtggcccatgactgcactgcacctgcctgggagggggctgtgggaggaaggcctcagagccacaggggcgggagctggggcctccagcactacctggtcgaagccgcggagggggatgctgcgcatcatgatggtggtgtccagcccaatcccggtgaggaagccagcacactccagggccacatctgtggggtgccagctaaggagcactgtagatcccaattttggaaatgatgggacaacaccccagggccctgtgccacagcccacaccccacccatccatggctggccctggaggaggctcccaactcaagacccccacctccacatctcaagtgcacaggctggggttagcaaggagccgccaagcagcacccacggactaggccggcctctggcctctgctcccatgtgctgtccatcccggctccagggcgaggcctgcatcctggtggattccagttgggatggagaggagtggctggttcagggaggacctcagccacgggagatgccaggcagctgctttcttccacctgtgctctcagccagcggcttggggcttttttttttttttttttttttgagatggagtctcattctgttgcctaggctggagtgcagtggcatgatctcagctcacagcaacgtctgcctcccaggttcaagcggttcccctgcctcagcctcccaagtagctgggactacaggcatgagccaccgcgcccggccagggactttcatctccctcagatgtccccttgaccccaggccctcctgcagctcctctcctgaccctccctgtctaattgtcccttctgaagcaatgggtccaggctggggctgctcttgagggaggacagcccagctgcctcatggccatgtccagctgtcccagctcaggaagagcctccaggaatccctggccagaggtcagcctcaaactgtccccaggcacagtagatcctccacgccgagaggcccagtaagtgccgatctgaggcagcaaagagcctgccggaagggcgggtggcagggagggactcaagggaaggagtgtccagttcccaggacggccacctgcacgcttgcaaaggatacagctggccccgaccaccaacctgttagagaaacagagagagagcacatgtaaagctgaggcccttattgaccaagtgcagtcagagcagaaccccgcagcctttgcccaggcccttggtcagctcgtgggctccaaggttactgttcaaacagcttgccccaggggacaaagcccactttccaaggctacactgtcaagcatgttgtgaatcagcaaatcgcctggtggtgaagggcgtgtgtgtcagtgacaagtggtacctgtcccctggaaggcacccggaggcatggagaaacatccaccagagcagcacatggctttccttctctccccccggggcctcctgggctagggtggaagctgggagatgcttggcaggatggggaggccaccagaccgcaagggaagacatcatctgagcaaagcactctcaagaccacagaaggctgggcccttccatgtgccagaggcacatccaaccctatcacagctaggcgcagggccaggagggccagctccccagagaggggactgaaggaccccagggacaagggaggcagcacaggacactgcgaccagcagtcattggaaatatttgctcttgtagtgaaaaccctctattgttcaaccccacactccacatgtgttttgcatgcacatgtactcacgcacacttgtatgtgcacacatgccacacacctgcatgcacatactcttacacgggcacaaatgtacacacacacgcacatactcgcatgggtacattcattcatatatacatatgcacacactcatgtagacacatgcatgcacacacatgcaaacgggcacagaacctaacacgaacaagaactcccagcggggcagctgcacgtgggtgggctcccacattacccttcagtctttgaacaagaggaggtgatgtaaggacggataagcccaatgtcattgctaatcccagcaggtactaatgatataattccatttcaaaacacggtgtatcccttggaatcattctgcaggtgccctgcgggaagcatctggcatgcagcttcctcactgtggctggggacagaaccgcaccactgtcaggattagggtgagcagacagagctctgttggccggctgagcacaaggtggttacatgcctcactcagcatgtgaggacagcgaagggggaccctgggacccccagccaagcaggattgcagagatgcattcccagccccgctcagggccggcaacacttgggaaacaggcaccacggtatgcacgcacttccacacatgcacacacacataggcaccacatacacatctctacacggaagtgcacttccaaaatggcgaaaccaaactctttttggacttgctatatgcagtgaaaggtacaagcttttgtttaagatatgaagttatggccaggtgcggtggctcacgcctgtaatcccagcactttgggaggccgaagcaggcagatcacgaggtcaggagatcgagaccatcctggctaacatggtgaaaccccatctctactaaaaatacaaaaaattagctgagcatggcgatgtgcgcctgtagtcccagctgctggggaggccgagacaggagaatggtgtaaacccaggaggtggagcttgcagtgagccaagatcgtgtcactgcactccagcctgggcaacagagcaagactccatcacaaaaaaaaaaaaaagatatgaagttatgagttactgcaaatataaacagaactctgctgctttgcatatcctgccctaaatgcaagggtgtaactgggcgagagcccattgtgtggtgccctttgccccctgctcccagaggtggctgtgcatgggctagatgcttcctgctgggctgtgcaggcactggcagagtgaggccaatgcatcccctctgtgggcagctgggcccctgcacgtcagggccttcctggccctgaaggccaacccttctccaggaatgggccctgcagctgcaggatgggggccaggctgctctccgggcctcctagctcattgctagggatacagcaacacaccctcctgattttgccacaaatgtttgctgtctctgccaccgacgtgtacatccccacctcctacacgatgctgacccaccaggcctggattggagcgggggcaggtgactctccaggccctccctcggagtcccccagtgcccgggcctcctgtcctggcacccacggggcacaggagaagctcccgcctcaagggccaccttcaaagtcacaggtgcccccatccctcagctgccagctctgaatcagcaactgagggtacagctaggaggaggtgggtgcagtgggcatattcccgagtgggcatccttgaccctatgtgttcggctgaaatctctcaacaaaagctcacgtctcgctcgtgtggagggtcattttgggcctcttcttgttgtcatgagcaaggattattgacagcattggttttcactgtacgcctccccgcattgatcaaattatgtgaatgtttaccctttgaagaatgcaggatacgagaattccaacagagaactccgttcagaccagctaaagtaaaaaaatgcccgagcaaaataagacagacaccaaagcctccagatcacagggatagagagtacccaaagacagggacctacagacaccttcttcaggccattcacggcccagcaggggtagggacagacaggaacgtggtgcagcaaccaactcaagccatgactggccacaggaagtcagaggtgctggccacagaagtcaggggaccagctcacaggacctgggggtagggggctggaaccactcaacttaccgctgcattaaaagacccagaggttgggtgcggtgggtcatgtgtgcaatcccagcactctgggaggccaaggtggacagactgcttgagcccgggagttcaagaccagcctgagcaatacagcttgtccccatctctacaaactaaaaaaattactggggcatggtggtatgcacctgtagtcccggctactcgggaggctgaggaaggaggatcacttgagcctaggagtttgaggctgcagtaagctgcactccagcccgggaaacagagtgagaccctgtctctaaaacaaacaaaacaaaacaaataaaaatcagttttccatgtgatcccagcagctcagctctctgtgctttttggtgtgcaaacattttccaaagaggcataataactactgcaggatgagcctaatcacagggcaggctttcttgttcaaaattggaatggggggaggaagcagaaacaaaagcattaattcaggcccacgaagcctaggcttaaagagcaatccatctgcctcttgagcttgaaggcctgctctccagagggaatactcacacaaagtgagtctcatgggaggcacctggccccttggaggtcctgccagcccaggaaataccagatgggccgccaagctgcagatgccccagggaggcagcacagggctgggggtgctacgaaggcctccttccccggcttggctggaaccccgccgccccacccaacccctcaggggcagatgctgggccggagcctctgtgtgctggccctgtaacaaatgccactgaaagccctaccttgtcatgtcttagccacagggacgcacacagagaggtggcgggggctttgcagtctggtaacaagccccaggaggacagctggtctccctattgctgaacacaaggacatcccatcacaccagcggaatgtgccacttaaattaaattttctcccaaatggctgtggttcttcccaagataaaatttatcttcttccctcttgtgcttaggaagagagaaaaatgatcgcagtacctggctggcttccggacttcctaagggtcaaataaaagctctttccatgacacactgacaggcagccttaaaccagcccaagttataaaaacactctgcctcttggagccccaggagtgcgaggacagacagcagcaggctggtggagcagcctcagagggtggacaggcctggctggctgcagcccctcccccagggcccagtgtgtgggctggtcagcccctgagccagcctggcagctgcaggagaggctggccccatgctctgtaaacccccacggggacctgggcaggggctacagagctggcagcaggaacaggcagaccctggttgtttccgggaagcagtacctccgttatcggacctgagaggaggctgcggtctcattcacgccctcggccccatcccagtgttgccagctcagagccctgctttgcagaaagcggacctacagacacagcaagagggaggactagaatagagggaccacaattccctatattggggttagggcacctgagctccaaaacctggcactgagggagaagacgaagcccagggccgtgggtgtgcaagaggcagagacaaggcacactggcggggcccaagtccctgccgggtgcggaggcttcccggtggaggcagccctccaggtcaggaagtggcaggaagattgtgcggctgtgggactggagttggagctcagctccttggccccccttaattgccaggcccctctgggcctcgggctcctcttggctgcacttggatcccgacccccagtgcctgcctctgtaaaggagctccccggtgtgggctcaccatcctcgccttccacattcctccacctgccgggggcttgctctgtggaatggaaggtttggtttgcaaggctgcatgccccctctgagcctagtcatttggggtcacgtgcccctccgcacccctgcctccctgcagtggccattgttcccagaggggctccactgcctgcccagggtcactgtacctccccagaaacctcctctcttcttcaacctgtcttgcagttccagagaaggaaagacacaacacagcagaaaaggcaaacgggctggcacaaggcgggcatctgcatggcagaggcggagcaggagccgacctggagtccttcccagggtccccaccaagactgggaggacagtcccttgcgccagggcgtggctatgggagtggggcagccagaacgtcccccgccccaccccagtgcactcaagggtcctgctcacccacccacaagctcacactgctttttcaggagttttctgagttttctgcacgtcttcctcaccctcctaggttacaaaccaggtgctcagcccactctggtcaacaggtatggccccattttgccagcatatggctgtttagtgaagtgcactgtttaattctgtctccccttgactgagcttggacacgatccccctgcctctgccatctgtccagccctgggctccctaagacctggatgcaaacaaaggaggaagggggctcccaacttggggcccgaggtgcactgtgatgcctgagtggcctctctggggcaaaagtggcatggtacgaccttgcaggctgggtcccaggccccactgtgggcaccactcgccagatctggagctcccggcagtgggccccacacagacgtgcgctgaaaggagttcctggtggcagcctgtgcctgtagtagagagggacgagggaggcctcgtgcacgccgcagagcccaccgagggcctggggccagggggacagggagcctccttggtggaggagccaaccaggggacagagtgcccactgcaggaggggcactgtgatgccaggcaccgtgagttgcgcacctggcctccaggatgggaccaggtagaaatgtcccacccgactacgggaggcactcaggggccaggggagcagccccggggtccatattaatttcagctccattttaaaggcgagttaaaataaacatggggaatatttataaggcaaataaatctggcagaaacagcccctccaagtgtgagtggaggcctcccctcagccccagcccaagctgataaaatacagaaatgctactgtagaccctccgggcttattttgactgcagcagaggaatgtaacatgtaaacactgactcccatattacactgttacaacttgcattaacagcgccggacaaaagccgcattttcacagaagcatcgtacagggatatatctccagcttaatttttaaaaaaaccatttcctcacataaatcatgctcagaatgaaacgggtgactgatacattgcaaacactttttttcttaaacaataacatacctagattccttctaaacgaaagagctttaaaaaaaatcttctaaatgttttttttctgaagaaaataaacactgcagtttcttttctgaacaaaatatctggagctgtgtcttcccggccgagccagctgcccccagcacagggttgcagaggagcgctccccaagccccagccaccttgctagggagacagcaaggccagggcacccagagcaccgggccccctccccaggcccaagcgggcagcctctgaggggaacaggcacaacgagggtggtgaaagtgctgggctgcagtgaccgtcaccgaagaccccagtacatcgaggggcccagcagacatcctggggctgccagacatccaaggccatttccctgaaggtccagcagacaaagcatcctgcaggggctggaggggcatccagactccacccagagaagcctacgtgaaagacaaccagaggcacaggcagaactcaggacgccgagtgagaacagtgcctcgagatgggcactggggcccgggcaacccatctccaccacaccgcagaagaagtgcagccagcccaaggaagtaaaagaaaatccgacttgtggacgcccataaggaaaatacagggcttaaaaaaaaaaaaaaaaaatcttgggggtggggcaggcctttctgaacatgcaataaatcaaaaagccactaagtgtaaaagatttaagttacattaaaaaaaacttaaaccatttgtacatcacacaagttaaaagacactagaagctgagaaaatctgcaccacaagcgacagaggatcacatccctaatacacaaaccagctggagggtaagaagagataagagaagagaaaagccagacgtgaaagtggacaaggaccatgctggcgatttgtgcagcacacatgggcatgctcacagacacgctcatctcaaatgaggctgtgacacgaggcttttcaggtaaatgtgtgaaaagaccactgatcacagcaaatgcaaacagagtcagatcatgtgtaactcagcagatagtcaaagattaaaaaaacagtctgggtgccgtagctcacacctgtaatcccagcactttgaggggccagggtgatcacttgagcccaggagttcaagactagcctgggccacatagcgagtccttgccctaaaaaaaataatcattagctgggcgtggtggcgagcgcctgtaatcccagctactcaggaggctgaggcaggagaattgcttgaatccaggagatcaaggctgcagcgagccatgatcgcaccactgcactccagcctgggcgacagagcaagaccctgtctcaaagataaaaaaacagataacccagaaattatggcataacaggaaaaagtgattggtgtgacaacagaaaaacttaaaatttctgcatgaaatactatcaccaagtccaaagacaaaccacgatcagtgggtccaatggaaggcagcaggcagtcgatggaaaccagcacaagctcagcacagtctcaggagagtgtgggcgccgtgggtagcagtgaccactctcaggagagtgtgggcgccgtgggtagcagtgaccgctctcaggagggtgtgggcgccgtggatagcagtgacggctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgccgtggatagcagtgacggctctcaggagagtgtgggcgccatgggtagcagtgacggctctcaggagagtgtgggcaccatgggtagcactgaccgctctcaggagagtgtgggcgcaccatgagtagcagtgaccgctctcaggagagtgtgggcgccgtgagtagcagtgaccgctctcaggagagtgtgggcgccgtgggtagcagtgaccgctctcaggagggtgtgggcgccgtggatagcagtgaccgctctcaggagagtgtgggcaccgtaagtagcagtgaccgctctcaggagagtgtgggcaccgtgggtagcagtgaccgctctcaggagagtgtgggcgcaccgtaagtagcagtgaccgctctcaggagagtgtgggcgctgtgagtagcagtgaccgctctcaggagagtgtgggtgcaccgtgggtagcagtgaccgctctcaggagagtgtgggcgccgtgggtagcagtgaccgctctcaggagagtgtgggcgccgtgggtagcagtgaccgctctcaggagtgtgggcgccgtggatagcagtgaccgctctcaggagagtgtgggcgcaccatgagtagcagtgaccgctctcaggagagtgtgggcgccgtgggtagcagtgaccgctctcaggagagtgtgggcgcaccatgggtagcagcgaccgctctcaggagagtgtgggcgccgtgggtagcagtgaccgctctcaggagagtgtgggcaccgtgggtagcagtgaccgctctcaggagagtgtgggcgccatgggtagcagtgaccgctctcaggagagtgtgggcgccgtgggtagcagtgaccgctctcaggagagtgtgggcacaccatgggtagcagtgacagctctcaggagagtgtgggcgccgtgggtagcagtgacagctctcaggagagtgtgggcgccgtggggagcagtgaccgttctcaggagagtgtgggcgccgtgggtagcagtgaccgctctcaggagagtgtgggcgccgtgggtagcagtgactgctctcaggagagtgtgggtgcaccgtgggtagcagtgaccgctctcaggagagtgtgggcgccgtgggtagcagtgactgctctcaggagagtgtgggcgccatgggtagcagtgaccactgcccaggccaggggtatgggaggagaggctcctttctgttttgtgtcttatcaaaaagctgatgcctgagttaccaaggacagggaagcaggcagagtacacatggaattggcctgtcagcacaaagtgttaagacggaagggcagctccccttgtaaagcgtataagaccacctcacagccactaggatggccactgtcaaaaaaacagaaaacatcaagaaaacagtttaaaggaaaaaataaaaattaaagaaagaaaaacagaaaacaacatgcactggcgaggatgtggggagcccagagtcctcctgaactgctggtgagaatgtaagatggtgtgggcgctgttgggaacaggatggaggttcctcaagaccataagatccagcaatcccacttctgggtttgcatccaaaagaactgaaaggtcttcaagaggtatttgcacacctatgttcacggcagcactgctcacaacagccaagaagcagaggcaacttgggtgtccactgacagatgaatggataaacaaaatgtggtgtgcctgtacaatggaatattactcagtcttaaaaagaaggaaatgcagatacaacatggatgaaaagagttccagacatggatagtggtgatggtttcacgacattattaatacatttaataccattgaactgtatacttaaaaatggttaacgtgggctgggcgtggtggctcacccctgtaatcccagcactttggaaggccaaggcaggtggatcacctgaggtcaggagtttgagaccagcctggccaacatggtgaaaccccatctccactaaaaacacaaaaaattagcggggtgtggtggcagacacctgtagtcccggctactcagagggctgagacaggagaatcgcttgaacccgggaggcagaggttgcagtgagccgagatcgcaccactgcactccagcctgggcaacagagtgagactctgtttcaaaaaaaaaaaaaaaaaaggttaaagtggtaaattttatactatgtctgttttatcacaatgaataattgggaaaatgtgtcagaagcacttctgatggtaaacagatgcacctccaaggttttcactgcagcattgataatgatgaagaagagaaactactgagatgctcattaacaagagaaaggtcaaaggaactataccacatccattcaagggaatccagtcctgaccccacacaaagatgccccgtgaagtgtgaaacaatgacaagcagagcatgtgacacaccactcacacacacacacaccactcacacacacacaccacacacacacataaccactcacacactactcacatacacacaccacacacacacaccacacacaccactcacacacacacaccacacacaccactcacacaccactcacatacacacaccattcacacacacaccactcacacacactactcacacacactgctcacacacaccacacacaccacgcacacacaccactcacacacacaccacacacacccacacccttcacacacacacaccacacacaccacacacacaccactcacacacaccactcacacacacaccacacaccacacacacccacacccttcacacacacaccacacacacaccactcacacacaccactcacacacacacacaccacacacccacacccttcacacacacacaccactcacacaccacacacacacaccactcacacacacaccacacacaccattcacacacacacaccacacacatctgcacgcacaccatgcacattcgggcacacacagaagtgggacccttttccactgatattttctcctggggaaggctcgagactgctattgaccaagcctctgccgccctctggtggtctctctgctccctgccaacatgaagtctccacaccccacaggcaggagctgcctggacctgggacctcgggatggcccactctgtgggcatcggaatgcacttagtgactctgcacctgctcccatggggagtgagagccacttgcacgctgctagcctcccttccacaatcaagatgttgtttctgaggcctttggagtctttgctagatttcagggaaacccaatgtacaaatcagaagacagtgagggtgttagatgagggctgggatagggattgctggctctcccctccttaatgttctccctgatgtccttgaggggacccactggaaccccagggctcctgggaaccccatttgacaaccactgacctagataacaaacagctgactccatttatatggcagtcctgttattgttattacctccaaggcagccacaggacagagtaaatcaacagccctgcagaggggcacaagtcacaggtttattgtttagttttgagacaaggtctcactctcccaggctgagcgcagtggtgcaatcacagctcactgcagcctcaacctcctgggctcaagcaatcctcccacctaaagcctcccaagtagctgggactacaggtgcacagtactatgctcggttaatattttcagatttttgtaggctgggtgtggtggctcacgcttgtaatcccagcactttaggaggacgaggtgggcggatcacctgaggtcaggagttcaagaccagcctgaccaagatggtgaaaccccatttctactaaaaatacaaaaattagccagatgtggtggtgggcgcctgtaatttcagctactttggaggctgaagcaggagaatcacttgaacctgggaggcagggattgcagtgagccaagattgggccattgcaattcagtttgggggacagagtgagaattcacctaaaaaaaaaagccaaaaaaaaaaccaaaacagatttttgtagagtagaggtctcactatattgcccaggctgatgctgatctcgaactcctggcctcaagcaatcctcccgctcagtctcccaaagtgctaggctaacaagcatgagccaccacacctggccacaaataacaggccttttttccttcttttgggtaaaccggaaagaaagccccaggagcccagcaccagcacaggctctaagggtccagtgctcactctggtgaacaaaaagaggaccccaccaagcacgcgcaggccttacgtttttccaggggattccttcagccagaagatgtcatcacttgtgattccatattccaaggcaccttcgatctgtcaagacagaaatgaccccttggacaagagctccatttggcctgtcctagggcttccttaaagaggatgccagctttgcagaatcaagcagagctttcccagggcacacatgcacagggcttccctgctgccagtccttgtctgcaggctgtggcctctttggggctgcaggtggcctgtctgcatctaagctgctgcactccaggtcccggtgccctcgcagggtacctttcccctctgttccccaggaccctccccttgaccctggttcagagcaggatacagggcctgaggtgggtacagcaactgcaggggccatacaggcagacagctgggacccctcaagtctgcccgggttctggacagacacatcaaacagacaggggcatgcagccccagggagcaacacctgggttctgggggatccaaactcagagagaggaagtggggagagaacaggtcagcaaatcagggccagcagagctcaggtgtgtctgcgcggcaggggtggcctacaaggccagccagaggagaggaggcacagggggtaagtgccacaggctgaggtgggcagggactgaggggcagctctgagggcacctggctgaagccaggacggacttcacactctcgagggctggcccgggtgggctctgagcccagaaatcatacaggtcacctgaagaggggcggccaagcaggtgggaggcccagggtgaacgtccccttagcggccatgagaacaagatgtgctggtggaggaagcggatctcaaacagtttatgcttccaactggcaaaaaaaaataaagtcaggaatttctcaggtttactcaaggaaaaccgaaaggtctggcaatcaaagggactaaaacgcaagcaagccttggcagacaccctgggagggcgtggcagggagagcgaagcagccctgagctgcctgcctcctaaggaccaggagcgcctgctggatcccctgtgagcccaaagagccgtcagcagctgcccgtgaggtgcagagcagggccgggccaggccagggcccctgtgcagtgctccctggtgcggatgcacgtgcagctctgcctggggcctcagagaaacccaatgaccgctgggctgctggaagctggctgtggccttctttaagcagaaccaccatgagcccagctgccaggagaggggatcactgggaccctgtctgcagcagctgccttgaacaactgcacagtgtcatcctacaaagtcacgcagccctgagccccacctctgtgcataagcaacctgccccctctagaggctgctgtggctgcctggcggccagacaagtcccacggcctctaaggactgggggtgcttgtgctcctcggggccgctcctttccctgtttccacagtaagcacaggacgaagtggaggctggggtcacatccaagaagtggcagaacctccccttgctctgcctccaccggactgcccctgggtctaagtcagaggtggtgtggcctccaggccgagagagccgtggtcttcaagagcttggctgcagcctacttagaggcttggagcaggcggcacacggttccctgggagacccgtggggactggtctcagccaaacctctctgctcacccccagcccatttgctttccctgctgcagctgccccccaacccctcaccccggggccccttcctcaactctgcccccacaacccacaagactgggccaggagttattcacctctctgttaaaaacagcgataaaactggcaagaactgggagattcagaattatggaaattaaccacaggcttgcagcaacacagggaacatttaaagtcaggaaaaacagctgaagctgagtgagaatgggaactccagggtgttttaactcactctggtcccactcccacctcagcggcagccctgaacagtgatgtgtcagagagagcagaactcagctggggtctttcaaagcccccccacaaagaagagtcagagtcagcaactatagggtcatcttcatccaacttcaccggagctcagccagggctaaaagcctttctctgggggcatttgtctgaggttttcttctcacagctgcctgaggggataggtaacagttagagccaacaacagactgcccaaaaagcttcaaaggaaaagccaaagtatgagatgtctgctggagctttgaaaggttccagcatattcctgggaacctaggccaggcgcatgcacagcactgtgcacacatcaggaaggaccaacgaggccctgaaccctcacctccagctgaccttgatctctgcagaagcaggaagtgaaggctagggcagagctgtctgctgcctgttgagtgtggaaggcatcccctccaaacgcacacagagccctcagcaaagaccgggagagttcttagtttagggaaatctccatgcagttcttagctgaccactaagctaaccaagtaaagacttcagtggccacatacatcaaagaataagagtctacaaagtcagttccgaaaagtcaccaaataagcagctgtaacaacagaatcctggggcagagggagaatctggtttccaaagttatcgcattaaattatttgaaatgttcagctttcaataaaaaaattacaagatacgtgaagaaacaagaaaccatgacccttacaccccactggaaggaatgtaaaacacagtcattgtggaaaacagtctgaggttccttgaaacgttccttgaaagattcaacataaagttaccacatgacccagcagttctgctcctaagtgtaacccaagagaagtgaaaactgaagtccaccaaaaaacttctttgcagatgttcacagcggcactattcataatagctaaaaagtggaaataacacatgtgtttatccaagcaagtagataaacaaagtgtggtctatccatacaatggaatagtatctagccataaaaaggaatgatactgacacacactacaatgtaggtgaacctggaggatgttatgctcagtgaagtaagccagtcactaagggacacacacatacgagtcactaagggacacacacgtaccagttacatgagaaggacttacatgtacgatttcacttacacgaggtgcctagtgttgtcacattcatagagacagaaagtaggtggtggtttctaggggctgggggaggaggcgctggggagtagggtttaatgggaatagtttcagttcagggatgatggaaggagttctggcaatggatggtggtgactgatggccgcacagctctgtgaatgtactaaaaaccactgaattgtaccctaaaaaaggctaaattttatagcgtgtgaattttatttcaaactttttttaaactgggggacgtgaaggaggaagatgaagaatgaggcttatatcctgaatgttccaacattctgaggctgaagggaaaagggggaatcagcaatggagacttaggaagcaggatcctggtgtggaaggggacagatccagcggggcagggggagagcagaacgagagctgtcctgaggatctggcagcgtggaggccactggggaccccacatttcagcagtgtggattcaagagaattggaaagcagaaagtgatgatagtgagtatagggggaaagggtgtgcaagctgctgctgtgggaagcacgtgtgtaaaaacgtatccctcaaagaggccgggaatgggccacggcagcagggacgctatgctctggggacactcacgtgcgtggggtatctcggccgccctccagtagcaatgatgatgtgatcggctgacagcagaatctgaggagaaaaagagaaagccgtgggtcagacaggtgcatggtgatcaccccaccggagggcctgagcaccacagaccttggccagcagttcccacggcccctgccctgtagcgtggacccttggccagcagttcagaggccctatggagctggaatcccatcaaccatcagcctggcaggagggggacaggcagaaagcacagggagatgttctaactccaagcacttcaaggcaccctcaaatccccaaaaaatcctgcaaaaagggtgtggtcaccaaccctgttgccatgccactccgagcagcagggcagcaaattatttgatcacgttaaagacaagtgcccagcctcaaaagaagccacctttttgattccagcagcacgtgttactaagaacagcacccaggccaaacacagctgcagttggtgcccaaggtctgcagaagggtccacaaggagccacgcgagtaagtcagatgctcacctctttcccacctttggcaacgccgcaaaccgtgtgctcgtcaacaaagctggctttgatgttaaagtacttgacttttctgaaagataaagataagattttcaaacacttcctctgcaaattaaacctcaccaactggatcaatagggaacactggtaaaagggagctccagcccccagcagggcctggtgctgtggctcagatggaccaagaggtaagcggcaaccatgctgagaagcatggaggggatgtgggggcacctcgcctgtcccccagggatcccagggacatgttaaccacaggtgtcaaagcagggacggaagccagctcagcacggtcctaagaggccacgtacagccctggtgtgcagcaagaggtggctggacctctcttggggacagtcctcatcacccggacatgttccagcagggagctgtggtgcccaccagatggtgtcaccttctgatttcaggggtgtggtaacaccaagagaacgggcatgacaaggctggcaaaacagtggctgggagcatagtgcacagaaacaaatgacccacgctttcttttcttttttttttttctgagtcaaagtctcactctgtcgcccaggctggagttcagtggcacgatcttggctcactgcaatctccacctcccaggttcaagccattctcttgcctcagctcttgcctcagcctcctgagaagctgggattacaggcttgcgccaccacgcctggctaatttttgtatttttagtagagacggggtttcgccatgttggccaggctggtcttgaactcctgacctcaagtgatccacccacctcagcctcccaaagtgctaggattacaggcatgagccaccgcgccccacccttttttttttttttaaagacatcttctcactctgtcacccaggctggagtgcagtggcatgatcatagctcacggaagccttgtttcaagtaactggaactataggcatgggcaaccatacctggctagttcattttattttttgtagggatgtagcaataaaactatgttgctcaggctggtctccaactcctgggctcaagtgatcctcccacctcagcctcccaaagtgctaggattacaggcatgagccactgcacccgaccaacactttctaatgacaaaaggaccgtgctgcagcaagggttctgggaaggctctgcctcctgcttgagcctgccttctccccactggcaagcctgtgcctctatgggctgtctgagctgcgtgaagttcctacagcaagagcccttcaatcacctcgacagccaggaagctgccacgggacacagccgggcaatgctcatggcagcacttttcagaagagtgaaaaagcagaaacagcccaggtgcgccccagcctccttctgcaggtggctccggagcaggcagtgggctgggcctgtttggtgcccgtccaggagctgcccagggcagggaggagggagggcagagcctgctgtccccaggaaactgtaccaggggatacagagccccacagagaaacacagaaatgccacagcacaatgtggcttagctccctggataggggagagcttgtgaggtccaggtggagggcaagcagttggcttcctggctccactttcctggatttagtgagcacaaaactgctgcctgctgtgaagccccaggaagacccgccctggggccaagcaaatggtgcatgaggagagccaccagacctctgcgggaccactgtcccctccacagccccgggagaaaggctgggccagaggcggtaccagtttcaggcatctgctgtgctggcagctgagccccaggagaaggttgtaggccaggggagcataggcctctgtgctggagatccccaggggctgacaggaacggtgaccaagtagggacatttgctccagcggaaagcaccaagctcctgcacccacacccaaggagctggaggtgtgcagtaagaagggggttcacggggtgggggcttgccactgggatgaccctcaccacatattagccccaggcctagctatgtccacgctctctggcctgaggccttccagccccaagcgcctcctccctgtgcagccctgggctctggccattctgccaatgtggcctcactcattccttggcagcacctccaggctctgctcagcagcaaagggcagtctccccttcccctacagtcactcccatctgctccttgtcctcatccccacccatgagcaggacatgaacccccagagcctgccagagcatgctctgcacagtaagtaagtgtgtgtccaggcacagaacgcccaagagaaggcccagagggcggcccattcccggagagagcttcagtacctgtcctgaagctggacacggtggccccagttcaaggatttcacgtgattttgaacagcttctgccatcttcctcctgtgaagatacgaaacaaaatgtaaaatccacaacacaggtgttagctgcagggcctcacgatggactattagattcaaatggtacattcatagaaatatcaaaaaacaagagtgcttttaaaggtggcaaaacgtgacatccatccctacgtgcaaccgcctgtcccaggctcagggctgcagacctttggactcacagaaaacaggggctctgacccacggctctccagatgcagctgctctgtgccccaaaggctacccactgcaggcagaggcctatctgagccaatgtgggtgtggctgggccacgtggtccccttcccagaagagctcagctgaagcggcctcccacccgcactcctggccttggagatgcactgttcttggtggggctgtgctgtgcatggctgtagcatccctgggctccccgcaaaggggagcaaacccttccccagtgacaaccaaaactgtctccagacattcccaaatgtctgaggcagacagcgcagagtcgcccctggctgagaaacccatcctacggcccactccccatgagggctcatcgaggataagcctcctcttcctcttccacccaagagtagaagaaaagcactggaatgccacggcgccagatccttaccagtcatgcggcacgggctgggccacctcccagccatagttgggggcatcttggatcaggcctcccagcagtgccgcctggtgcatcagcttcttggggatgcagcccacgttgacgcaggtgccgccgaggccccaccgggtgcctgggacgtgggaagagcacatttgaatttatgttcaggtgactgctggaggcttccctgttcttctagagtgtttggaattccttaaagttgctttgtaactctaacacagaccagctgacatgccacacgaatctgctctctataactgtactcgaaaataaaaacagttgtttttactttttaatatttattaatttatttatttgagatggagttttgctcttgttacccaggctggagtgcagtagtgcaatcatagctcactatagcctcgaactcctgggctcaagtgatcaaggcctgccttggcttcccaaagtgctgtgagtacaggcgtgagcaactgcacctggccagagttgttttcgataatggtcaagaactttaaagtaatgatgagtgaaacaggacactgtccagaaaccatggacagcagggctgaaggactttggtgtcagctgccctctgtacaggaactgggcccacctcccacctccttccccaggacacccggctcccatagggtgctgcctaccttggggagaaggttccacgtagtccaccacggccaccttccttcccagctgggcggctggaaggataaggagagcagcaggtgagcatggggagctggctcaggactcaagaacaggcactcctcagggcttgtgaggtccagaagagtgtgggcagggcctgggcctgcggctgcccacacagtggctgagctgcgcaatgctagggacccctgatctgcctctgcgctctggcctgctgagctgcgctgcctgctggctctgcattgagtcttccagtctctttctggcactgcccacccagctgcgctgcccacaggcaggagccctcagacctctcagggcccgcagcctttgtaccatccacccctcacagtgctggcatcagccccacctgcccctgcatgttcacgttcaccataagcccagtgcccacccaagcatccctgggtggcatcccccaggtagccactcaccgggaatggctcctgactcagaggctctcccttgccccttcccatcccagccagagccccctaggtgggcattcgctgcctcactctcaggaccaggacaccaaagctcaggagaagtgacgcagcagccccagggtggaccagccccagagcaggagccgagacctgactccaaaccacacttcccgctgcagagccacccagttgccctcccagccagcagtgtggccacccagggccacaggttctggggccaactcagaaaccattagccaggaccgggcatggtggctcacacctgttatcccagcactttgggaggctgaggaaggtgtatcacttgtggtcaggagttcaagaccagcctggccaacatggtaaaacgtgtctccactaaaaataaaaattaaaaaattggccaggtgtggtggtgcaagcctgtagccccagctacccgggaggctgaggcaagagaatcgtttgagcccaagaggcagaggctgcagtgagcagagatcacaccactgtactccagcctgggcgacagagcaagactctgtctcaaaaaagaaagaaagaaaaaaaaaaaaaaacattagctagggctaatttcaagcttccatttgcccgggcttgggcactgcatcagcaaacttcaggccttggacttgactgcctcccaaggcacacacaaatctcatgaaccctaaaatgccaaggaaagtgtttgattcgtggctattagaaagcaagattagaacaaagttttgtaagagttcatttttaaaatccattttgcttggctgggtgcagcggctcatgcctgtaatcccagcactttgggaggccaaggtgggcagatcacgagggcaggagatcgagaacatcctggctaacacggtgaaaccctgtctctactaaaaaatacaaaaacaaaattagttgggcgtggtggcaggtgcctatagtcccagttactcgggaggctgaggcgggagaacggtgtgaacccaggaagcggagcttgcagtgagccgagattgtgccactgtactccagactgggtgacagagcgagactctgtctcaaaaaaaaaaaaaaaaagctaatgtccacaaggcacagtggctcacgcctataatctcaacactttgggaggccgcagcaggcagattgcttgagcccaggagtttgagaccagcctgggcaatatagcaaaaccctgtctctacaaaaaatacaaaaattagctgggtgtggtggcatgcgcctgtggtcccagctgctcgggaggctaaggtggggggatggcttgagcttagcaggtggaggatgcagtgagtcaagattgtgccactgcactccagcctaggtgacagagcaagaccctgtctcaaaaaaaaaaaaaaaaaaagccagtgtgccagtgtgtaactcccacatctgaccacgatggagcagcagggcccagatttaccctccccctgaagcaacccaaaacccaggtaaaatgcatgaaacaacgggctttcaggtactccatgtcaggtaacaaaggacctgagagagaggaaacaaacatggtgagccctggggagtctccaggacccagcactgcaggctggggaagatggggagaatccagcacaggagagggctgagaactgggggagactgaggcagccagaggtcatgcacagaagacagtgaggagggggctgcccagagaatctgagagatctgatcggcgcatgtgtcttgggaaactacctgagaccagacagaaccacctggaaggactggaggggacagagcccacacagggcaggggacagtgcctgttcccagaatctggactgggaaaagcatataattcctggggcgttgggtcatgccccagtagttgagaatcattagccctagactgggcactgctccatacccacctaacaaatcttttgcagaagacccaaaaggatcaaactgactcttaataactgcatcccagaacagagctcaataatagtatttctagaaatacaaaaatgcccagaacccaacaaggtaaattcaagtgtctggcattcaaccaaaaattaccagtcacacaaagaagcaggaaaatacacctataaaggggacaaaaaaaaatcagtcaatggagactgacttggaacagacacagatgtcagaattagcagaaaagatcaataaaacaggtattctaactattccatacttttttatttttatttccttgcttagatgcctcacttgtgtgccctaactccaccttatcacatatgatgaactatctgttcatgtgtctgtctcggtaactaaactgcagaactccgtcagtcaggggctttggtcctggtttgtctttgttgttccgggtcctggcccagagcttggaccacattaagtattcaaatggtttgttgaagaaattaacatgttaaaaacaaacctttctcacagaacactgttcctccttcagtgttcaagatcccagacctttgggtccctttttacctacttactccctaccaaaagttctctctccttcgactccagggtggttttataaacctcttatgcatctcaacttgcactatatggtagctacttttcacagctacagacttttggtgtgggaaggatctttttttctctttttttgagatggagtctagctctgtcacccaggctggagtgcagtggcgtgatcttggctcactgcaacctccacctcctgggttcaagcgattctcctgcctaagcctcctgaatagctgggattacaggtgcgcaccaccatgcccggccaatttttttgtatttttagtagagatggggtttcaccatgttggtcaggctggtcttaaactcctgatctcatgatccgcccacctcggcctcccaaagtgctgggattacaggcgtgagccaccatgcccggccaggaaggatattatatgcaatttgttctacctgcttacctgaagtttgagtctccttcataacatcctcaccaagtgttcacctatgcctggtgcctttgtctgggaatgtattgccttcccaagtggccatttaattttgggaactctcccaatataaaatttctcctcatattaattggaaatgttttcctataactcttaactatctccaccccctctcccacatgcccactctttaaaatttaaaactatttttttcctttcccttaagttttctctttttgaattccttcaatgatgactttcaaggatagattccttcaactaggatagtttaggtcacttctctccaaatgacccaccttctccaaacctctgttcagaaggggctgcgatgctcccagtaggaagtctgaggccctaaaaatgggcagctctcgacctgtcctggctctgggctgtatcagccttgaactcggtcacatcaaacatctgacttatagaagttaacaagcagactgggcgtggtaactgacgcctgtaatcccagcattttgggaggccgaggcgggcagatcacctgaggtcaggagttcgagaccagcctgaccaactgtagtttcacgaccagtagtgaaagctcgtctctactaaaaatacaaaattagccaggtgtggtggtgggcgcctgtaatcccagctactcgggaggctgaggcagaagaactgcttgaacccgggaggcagaggttgcagtgagccgagatggcaccactgcactcaagcctgggcaacaagagtgaaactatgtctcaaaaaaaaaagttaacacagcattcactgaaacccctgaggcttttttttttttttttttttttcaaatcttgtggacttctgactggtacaactgcagctgccttgcctggtaacttgggtacctggtttgtgggtccaactgcaggccattcaggtagacttgattttttttttaatttaaaaaaaggcttttttttcttttttcttttaaagagacagagtctcactttgttgcccaggcactggtgtgcagcggtgcgatcacagcttgcttacgccttgacctcctgggctcaagcaatcctcccagctcagcctcccaaagtgctgggaccacaggcacacaccaacgcccagccctcagtggttttgatggattagtgtatccccagaccctccgaaggggaggacagtgccttatctctctctttcttccaccaagaaggccacaaccggccttttaaccttgatccaagcgaggctgaaaagcaaacagggcgttcatcttcatcctttatagccacatagccacatctcccgcccacaagcagattccaccaccccccgcaccctaaggcccagcctcatcagctgcagcatcttcacctggcctttcacactgaagcagaaggggtgacggtttactttcagctgcatggtctccatcatacccgtagacccaacagctgagcttcccctctgtcccttctcctcagctcactgccccactagccattctgcatgttcaaacagtgcaggagcaacatggaagatataaccaaaggctcaagctggattgtagagatgaaaactacaatacaggagatgaaaaatacactggacgggattaatggcaggtcagatgttgcagaatcttttattggtgggtttgaaaacataggaatagaaactatccaaaatgaaacgcagagtaagaaatgtttctaatgaaaagagcatcagtaggttgtggggaagcttcatgcagcctaatatacatggaattaaaagtccccacatgtgaggggaagaaggagggactcaaggccaatgaaaagagaaaatcctaaaagcaaccaagacacactacagagacactaagataaaaatagtagcagatttctcactggaaacaatgcaagccagaagtcagaggggcaaaatttttaaagtactgaaaaaaaaaaaaaaagcggggggccaggcatggtggctcacgcctgtaatcccagcactttgggaggccaaggggggcggatcacaaggtcaggagatcgagaccatcctggctaacacggcgaagccccgtttctactaaaatcacaaaaaattagacgggcatggtggcatgcgcctgtagtcccagctactcaggaggctgaggcaggagaatggcgcaaacccgggaggcagagcttgcagtgagctgagatcgcaccactgcactccagcctgggcgacagagcaagactccatctcaaaaaacaaaacaaaacaaaacaacaacaacaaaaaagaaggcaaaataaagacgttttcagacatacaaaagctgagagaattcattacccccagagccatattacaagaaatgctaaaggatgcccttaaggtagaagaaaaataccagatggaaatgtggatcctcacaaaggaatgaagagcacagaaatacaatgggtgagtatgtgagattttctcacacgatttaagtatattttaaacaaaaataataatgatgtatcatggatttataacatgtaacagtaaacacatgatataataacatagaatgaaggttaggaggggtggaatagatgtatgcttttttaagggtagactggcaagttaaggtacatgccataaaccctaaagcaactcaaaataaatcaaagacctaactgtaagagcttgaactataaaatgcttagaagaaaacacaggtgtaaatctttgtgatcttggatttcttagctatgataccaaaatcataagcaacaaaggaaaaaaatagataaattaggacttcaccaaaatttaaaacttttgtggcacaaaggataccatcaagaaagtgcagggccgggcatggtggctcacgcctgtaatcccagcactttgggaggccgaggcgggtggatcacctgaggtcaggagttcaagaccagcctcaacatggagaaaccctttctctactaaaaatacaaaattagccaggcgtggtggtgcatgcctgtaatcccagctactcaggaggctgaggcaggagaattgcttgaacctgggaggcggaggttgcggtgagccgagattgtgccatggtactccagcctgggcaacaagagcgaaactccgtctcaaaaaaaaaaaaaaagaaagaaaaagaaaaagaaaatgcgaagaggccaggcacggtggctcatgcctgtaataccggcactctgggaggccgaggtgggcggatcacctgaggtcaagagttcaagaccagcctggccaacatggtgaaaccccatctctactaaaagtacaaaaattagtcgggtatagtggtgtgtgcctgtggtcccagctacttgggaggctgaggcaggagaatcatttgagcccaggaggcacaggttgcagtgagccaagatcacaccactgcactccagtcagggtgacagagcgagactccatctcaaaaaacaaaacaacggcggctcacacctgttaatcccaaccctttgggaggccaaggtgggtggaacacttgagaggtcaagagttcaagaccagcctggccagtatggtgaaaccccgtctctactaaaaatacaaaaaattagctggatgtggtggtgcacacctgtaatcccagctactcgggaggctgaggtgggagaattgcttgagcccgagaggccgaggttgcagtgagccgagatggtgccactgcaccccagcctgggcaacagagtcagaccctgtctgaaaacaaacaaccaaccaaccaaaaaacagctgaaatgtccagaacagacacatccacggatataggaagtagattagtggttgccaggggctggggagaggggggaagagactgactgccaatgggtacagggtattttggggagaaactaaaatgttcttgaataacacaggtttgaactgcacaggtccactcatacatggattttttttcaataaatataatcccttgaccgggcacagtggctcccacctgtaatcccaacactttggaaggccaaggtgggcggatcacctgaggtcaggagttcgagaccagcctggccaacatggtgaaaccccgtctctactaaaaatacaaaaattagctgggcgtggtggcaggcacctgtaatcccagctactcgggaggctgaggcaagagaactgcttgaatccaggaggtggagagtgcagtgagctgagattgtgccattgcactccagcctgggtgacaagagcgaaactcggtctcaaaaaaatatatatattatctctccatatcagcaagttccaaatctgtaaccaaactcggattggaaatacagtactccactggacatggtggctcatgcctgtaatccagcactttgggaggctgaggcagacggatcacttgagctcaggaattcaacaccagcctgggcaacatagcgaaacccaccttctccaccaaaaaaatacaaaaagtagctgggcatggtggcgcctgtggtcccagccactcgggaggctgaggtgggaaaatcgcttgaacccgggaggtggaggttgcagtgagccgagattgcaccatttactgcagcctgggcaacacatgagaccttgtctcaaaaaaaaaaaaaaaaaaaagaaaagaaagaaagaaagaaaagaaagaaaaagaaaaaaacagtattcataggatgcaaaactatatatacagagggctgactctgtatctgtgggtgcttcagggccaactgcctgactccagtatgcacaaatttcagtgtccatggattctgctaacagcgggagttcctgaacccagtcgtcctcgggtaccaagggacaaatgcatacgtaatgtgaggtatatctcaataaaactattctaaaaatatgaaacacttagggatgtatctgataaaatatgtgaaagacgtagacattgaaaaccacaggccaggcaccgtggctcattcctgtaatcccaacgttttgggaggccaaggtgggaggatcatttgagcccaggattttgagaccagcctgggcaacacagagagaccctcatctttcttttttttaataaaaaaaaaaaacttgagtaaaaaagaaactacaaaatgctgctaaaagaaatgaaaaaatacctaaataagagatataccacacgatccagttggtccatttttaggcacttacccaaaataatttaaaacatatatccacacaaacacacagacagacgttcacagcaatactgtccacaatggccaaaaggtggaaacaattcaagtgtccagctacaggggaacacgtacacgaaacggcacagccataaacagaacactactcagcaatgaaaagcaagaaaccatcgacactcgcgccaacgaagatgagtctcaaggtcattaccctgagtgaaagaagccagaagaggaagatgacatacagcagcattccgtttatacgcaattatagaaaatgcaaactatagtgacagacagcacatgcctggttgcctaggatgcagaagtgggggaagccggaaggaactgccaaggtttcagaaaatgttggggtgttatgggctgagccatatcccctcaaaatccctatgtggaagccctaaaccctagcacttcagaatgtgactgtatttagagatagggtcttcaaaaaggtaattaagttggctggacacggtgactcatgcctgtaatcccagaactttgggaggccgaggcaggcggatcccttgaggccagaagttcgagaccagcttgacaaacatggtgaaaccccgtctctactaaaatacaaaaattagccaggtgtggtggcaggcgcctgtaatcctagctactcaggaggctgtggcaggagaatcgcttgaacccagaaggcacaggttgcagtgagccaagatctcaccactgcactccagcctgggtgacaaagcaagactcgcttgcaaaaaaaaaaaagaggtagttaagttaaaatgaggccataggccgggcgcggtggctcacgcctgtaatcccagcactttgggaggccgaggtgggtggatcatgaggtcaggagattgagaccatcctggttaacacagtgaaaccccgtctctactaaaaataaaaaaaattagccgggcgtggtggtgggcgcctgtagtcccagctactcgggaggctgagacaggagaatggcgtgaacccgggaggcagaggttgcagtgagctgagatcacaccactgcactccagcctgggcaacagagcgagactccatctcaaaaaaaaaaaaaaaaaaattaggccatatacaggtacagtggccacacttgtaatagcattttgggaggctaaggcaggaggatggcttgaacccaggagtttgaggttgcagtgagctgagatcacgccactgcactccagcctgggaggcagaacaagaccctgtctccaataaaaagccaacaaaataagagggcatccacctgatccattaggacaggtacaggtagagattaggacatagacatgcacagagggacgacaactgccatctacagcccaacggagaggcctcagaagaaatcagccctgcccgcacctggatgatttctagcctccagaactgagagacaataagcatgtgttgtttcagccgcccagtctgttatggcagtctgtttattacggcagccctggcagactaacggggtggaggacacactcgccaatcttgactgcggtactggctgcatggacacatgcacacataagaatgatcaggttgcccattttgataggtacagttcatctcaaaaaagccacaaaaccacgtcatcctctgcagggaaatgccactctcatgaaaggcggagacatacccaggagctgtccacattccggattaaaggggactcaggtctctgcagctggtcactcccagcatgggagtgaacgcacagcccaggtgcccggtctgctaaaaggaacagcactaggcctcgtggctgcctgcgccatcgtttctgggagtggttctgagagtacagtgtggcactgatcctgggtgcctctgcggatccccaataggccaggagacttcccaggttcctacacactccccggcccccacagagcaagagtagtggatttcttttacaccatgtatgcttctagagcccaatactggacatcagagaagcacagcttcagggccaaagtgcccagttaactccctctcatttcagccccacctccctctcatccccttccctccccattcaccacaactgccctcttatcattgtgtagacatggccagagcagaccaggaactcctacagcagggcacagagtctggcaaagtgctggtggcctgtgcatcacgtgggttagcagagaactgcaaagtgtcatctctggacacctctgggtccagcccgttcgcccaacatctttactcaatgggtgccaggccaagtacaagactcacccagcagaactgaccatggaccctgggggaaggcaccagcactaagaacaaggacagggacaagcaggagggtgcagctccagcctcgcagctagccgggcaggggcagagagcaggcaggcagggtgacagccacagtaaggtgaaggagaggactgtccagaagcacgtgaaggaaagtggggagcccacggagggtgtgagtggtgggagctgagactagtcggattggggctgtcactgtgagtaaagcagaagagctggagggctggagctgaggaaggcagttcagccatgaagtgccacggcggccgctgggtacagcagacagctggagagtggcagggaacaagccacaacacagaggccactggggtgaccccagcagggaggcaacgcattttgctcatggacgttttctggacagcaccaccctctctaggggccctaaaagcttcgaggccttgccacgaagtatacagaatacataccctccttggcacaagccaggccaccagatcccccgccgaccaccaggagatcatagtcccgctgacctgctgagagaagggatgagaggtgggacggactgtctgtctggttaaacgtggtacaggatcaattttatcaggattggacactccattctgtgatggtcaggggtgacaagacaccacacaacagagcagaaagagtgactcgatacacatagtctgtgcaaatccagagaccaagccatatggtggtgaggttggccgtgggcgtgtgtgatcatctttgcaaatcacacgcacaccataccaaccactctgaactcaaacctcacccagtgttctcagccagacacagaactaagatattttcttttttattctatttatttttgagacaggatctcactctgtcacccagaagattgtagtccactgccctgcttgggggagggatgaaaggtgagaaggaacacggtcagcacagggctgggacatagacccggaagggcccccacgacaggggcacagtggcacaatcacagctcactgcagcctctacctcttgggctcaagtgatcctctagcctcagcctccagaatagctgggactacaagcaccgatcaccacgtccagctaaatttttttgttttgtagagatggggtctggctatgttgcccaggctggtctcaaacacctggcctcaagcaatccttccaccttggcctcccaaggtgctagaattacaagcatgagccaccaaggtggactaaaacattctcaagtccacgtgcctttcagttgtgaaggctgccctccgtcacaagtgagcaagaataaaagcacaggctaggggcggtagctcacgcctgtaatcccagcacttttggaggccaaggcgggtggatcacaaggttaggagatcgagaccatcctggctaacacagtgaaaccccgtctctactaaaaatacaaaaaaattagccgggcatggtggtgggcgcctgtagtcccagctactcgggaggctgaggcaggagaatggcgtgaacccgggaggcggagcttgcagtgagcggataccacgccactgcactccagcctgggagacagagtgagactccgtctcaaaaaaaaaaaaaaaaaaaagaataaaagcacaagcagcccctgtccctcacagctggccagtgcacacagccagggtcttggtgtgcccagctgcagtcagctaggagggaagccaccctgggcacagggagagctgcctgggctcaggtttcatccctggaattccttttgggctggttgtggtgtcgcctcaccttggtcctccatggtggctcactgcacatagtgccactctcagcctttttagcctgcaaaaggtgtcatcgtgtctactctgcaagctactggcgaggaaggcaggcaaggggcagccaaaaaagggagggatggagaagggactggagggaggaagtagagaggggaagtacactgaactgggcctgaggtccgggacacccagcaccaggcaccagccaactccctgctgaaggaaggaagaaataatagcaagtcatcagtctgctggggtgagggcagggtggggactgatgacaagactctagggtataaaacaagtagtgccctcagcccctctgcagacacgagcctgcccagatgagaagcaccaccctcccagagcatctggagccggtcgctgcttcagacaaggccaagaggttccatgatcagagcagggtctgtcatacaaggctgggcaacctgcccaacacctccatcagagcctagcgtctgccatgagaaggctgcacttatctttgcagccacctccaccttcctaggcaggcaaggctgcagagagtgtacttggagtgtcatgtctctccacaccctggccctgcagatgccccacagacaggtctagaacatgcactcctaaaggatacaagagctggagcctagaggagccctggctcacagctgagaaagcttgggaagctgcatccaggcactcaggccatggcctgcagcgagcctgccccacaaccaaacccacccactctttcacctggcagccagcctctgagtgcacgtgagatgtgtgcgcacctgcgggaactgacagagccacaactcggttccaacagccagtccaaagcacactcaattcctaattcaactcaagggctctggaaaggcctaaattgttgtaaattattctaatggctttaatataagtctagagaaccaaggactgctggtcagggagaaaatgccaccaggtcccccggggagcatgaacctgctgatggagaagcatctctctcctccagctgcctggtagccggaagctttgctcagaacgtccctaccttccatggcaggtgcctgtccttcttgttgccatagcagggcccttgttaggtcatcctgccctgcagcctcgcactgtgccccctctgtctgctatcaggcagggtgagcagctgtctgtatggatgtgcttatcttgggcagcttgctcgccccctgtgcacacccaggagccctctcgggctgataaacactggcatagggcagtcgtttgcaagcataggaaatctgcctttaagcacttggaagggcttgggtagcctgctgggaaggaaggaccccaaagtacctcaaaggtgggtagggcagatgctgttctgtgggaggaagggctgggtggcaggcgttacctggggacacaccacctgtgcactccagtgtcctggagaacctcataaccttgcctttcacccactttagccaggcataccctctccacctgcagggcttggccccagcaagtgtctgtcttgcctctgccttctgacatattgtccattaattttctgctcctctttgaacccactgcctggtacaggccagcaaagagcaggagcccagagctcatagcaaggcccaagagaatgcagcactgcaccagtgagggcaagtggaagggtcccccaaaatgtgcacccacaggcaggctggccacctcagggtgccacctcaggggccctcctgtatggctgctctatctagagctctttcctggcagcaggtgttgtcattctggctcctgttcaggggctgcatcgcccacccactccaagcctgggacagttcaggtcttcctactctaaaaggagaaactgcagggcccacagtcccagctactagggaggctgaggctggagggtgagttgaacccaggagttcaaggctgcagtgagctatgatagcaccactgcactccagcctggttaacagagtgagactctgtctcagaaaaaaaaaaaaaaaaaaactgcacccctagtctgggtacagtggctcacacctgtgttgcaggaagtcaggaaccccgaatggagggactggctggagccgtggcagaggaacataaatagtgaagatttcatttcaatatgaacatttatcaattcccaagtaatacttttatacttttttcttttttttttttttgaggcagattctctctctgtcgcccaggctggggtgcagtggcacaatctcagctcactgcaagctccgcctcctgggttcacaccattctcctgtctcagcctcctgagtagctgggactacaggcacccgccaccacacctggctaattttttgtactttcaggagagacagggtttcaccatgttagccaggatggtcttgatctcctcaccttgtgatatggctgcctcggcctctcaaagtgctaggattacaggcatgagccaccgcgcctgggcccccaagtaatacttttataatttcttatgcctgtctttatctcttaatcctgttatcttcataagctgataatatacatcacctcaggaccactgtgataattgtgttaactgtagaaattgattgtaaaacgtgtgtttgaacaatatgaaatcagcgcaccttgaaaaagaacagaataacagtgatttttagggaacgaagacaaccataaggtctgactgcctgtggggtcaggcaaaaagagccatatttttcttcttgcagagagcttataaatggacgtgcaagtaggagagatatcgctaaattcttttcctagcaaggaatattactattaagaccctggaaaaggaatgcattcctggggggaggtctgtaaacggccactctgggagtgtctgtcttatgcggttgagataaggactgaaatacgccctggtctcctgcagtaccctcaggcttattagggtggggaaaaaactccgtcctggtaaatttgtggtcagactggttctctgctcttaaaccatgttttccgttgtttaagatgtttatcaagacaatatgtgcacagctgaacatagacccttatcaggagttctgattttgcccttgtcctgtttcctcagaagcatgtgatctttgctctgccttttgccctttgaagcatgtgatctttgtgacctactccctattggcacaacccctccccttttaaaatccttaataaaaacttgctggttttgcggctcaggtgggcatcatggtcctaccgatacgtgatgtcacccccagcagcccagctgtaaaattcctctttgtactctttctcttcatttctcagccggctgacacttacagaaaatagaaagaacgtacgttgaaatattaggggcaggttcccccaatatctggcgcccaacgtggttttctttttcctaagtgcatgtgggaacccgattccctttggtaggtgcggagaaatgttcatcggtccagtccacagaaatgcttgtttggctccccaacgattggtgagttgtctgtgtattctccggggtaactatgggtcacgcagagtctaaacattatgcttatctctgctatattaaattcctgttaaaatgggggagttcgggttcccatggaaaatatggtcaccctattcagggcagtggaagaacactgtccttggtttcctgaaaagggaacgttagatgtggaactatgggatcatgttggtgcaaaattccgagaactggtcccaacaggaaattatgttcctgtcactgtttggggtgattgggccttggtacgtgccatcctaatgacataccaatcccgtgacaccctgcagttaccacagttttctgaatctggccaccctctacctcttcctcagctttcctctcccactcggccttcattatctgctcagcccctccctttgcctactcctcccccacctgacgatactgaggattcaatatctaactccagtgactttggcttaacatcaccccctgatgatcttatttcttttcacgaagagccgacacttgtagctcctgcggccccaactcagacagcccaggaccatatctatgctaactcttccctctccaaacctttacagtctttgcctccggagccatccaaactacaatttacctgtaattctgcaggccctcccccatccaccacagcccctcaccctcctatcattttggtccctcaaccggtcactttgccatccactcaacctgcttctctgtacccttcttcatgcagggacacccctgccactctggttgtgcaggactgggccagtaatcaccagtatgcttctgcctcttctgctcccccaatgcccctttctcacactcttataccagtccgaccccgtcaatctcagtttctcttatctatacatacttttcctgtcacttctatgccgactctatctcatgtgcctgctcttgaaactttcatgcaatgcttattacgccaaaacaaacaagtagattagaggcgtgggcttattcggtcatgctggaacctcctaatgctcaaggggtacaagtgtgtcgatatacgccgctcaatcttacctttttaaaagaattcaaggatgcttgtactcagtatgttcctacttctccatatgttaaaacggtattacagactctttgtaccgaggtcattttgcttcctatagactgcgaccttttggcaaaagctgttctaactccatctcagcatttacaattccatacctggtggtcagaggaggcccgcctgcaggctcagctaaatcgggctgatggcattccaattactcaggctcagctcacaggctccgataattactctgatactactgctcatttaggctttgatgctctcaccacggaacaagtaacaaaggtgtgtatgagagcttgggataaattacgcaccccaggccaagcttctgtttcttttactattgttaaacagggtcacaatgaattatatcttgattttttagctaaattacaagatgctgttgaaaaatctgtctctgatgagcacactcaaggtattcttcttcatatgttagcttttcaaaatgcgaaccatgagtgtaaaatggccgtgcattccatcctacgtcaaaatttacctgatcatgaggtgttgcctgcatatattaaagcttgtgaaggcgttggatcggagacccacagagctattctgtgggcaccggccatgaagcacggcaaccaaactggctcgactgattcttttcttggagcctgctataattgtggccaacttggtcatacccaaaaaaactacactgttaaaaacttaaaagcggccaagccggctcaacaaacacggccaaatgctcctgctactgtttgcctgcgttgtcgtaagggtaaacattgggcaagtacttgccactcagtctgatatagatgaaaatcccttgccacagaaccagggaaacaggaagcaaggccagtcccaggccccaatatcaaatgggacacctcggactcagaccaatgttgtgtttttgcgtcaagcagtcccaacgcagcccccagcacaaacaaatttacctacagccaatccagatgggtcccagcctcttcttctgtctcagtacaatgcttgtctacctccacagtaggcagcagggcggtcgatctctgtagtaccattcctctaaatttactacctaattctttgcctttaattgtccccatgggggtcactggccctttacctcaaggttcggtgggcctggtgttaggcagggcatccacctcatgatactaaaggtatcatagttcatactagtctcattaattctgattcctctgatgagattaaacttatgtaaacttatggtgtctgccaaagttcctgtttccattccggccagtgagtcaattgctcaattacttttactacctaacattgttttaaacaaaggagataagacatggggccctgggatgggctccagcggtgaaaaagccgcttattggattaatgtaatttctaaacaatggcctacctgcaccatacacattcaaggaaaaaaggttgagggcctagttgatactggggctgatgtttctattatttcctctaatttatggccttcctcctggcttaaacatcccactaacatgaaactagaaggtgttagaaaagctgaagaagttcaccagagcacatttatcttggcttgcactggccctgatggtcaaaagggaacaattcagccttatatcatgcccatccccattaatcttcggggcagagatttgctggcacaaattggggctgaaattaatattccacataacttttacagtgctcccagtcaacatataatggaaaacatggggtttgtttccagactcggtctcggtccaaaacgtgaaaaaattactaaacctcttcaagttactgtaaaagaagacaaggctggtttaaaagcataatttaactactccccactcccaattatatttagcattgtttaagctttctaaatgttcctaaaaacaatactctgactgcagctaaatgccattatacaggcaaaaaattctccctaaacgaaggcaagccagtgtcatggaaaaactcccaaaccaatacctgggaacctggaacaattataacgtggggaagagggtatgcttgtgttttaccaggagatcgtcaatcccgtctgggtgcccactaggagacttaaacttcgtgtgaatactgacaataaaaaccacgaggaagagacgttcgcgtcagagactgccctcatacctgatgagatctgtaccgactcctcagaaactggcatgccaaatcaaaatgggtctggttcaatcctccctaatggcaatgtaaacccctctaactaatcccacttctcctaattatctttttctccttacgaacctaaaaatctcaccatttctattagcctgaaaataacatccctctgttcttctcttcctccttcagcactggatctcacttacaataggttttatttaataattatcttccttacactttctgtctcaccagtttccccttaaactgatttacctgctacacaaaattattcttattgggcttatgtgccttttcctccacttattcgacctctcacctggatggatgctcctgcagaaatctatactaacgatagtgtgtggatgcctggaactacagatgaccgttgcaccgctcagccaggagaaggcactgcatttaatgttactatgggttataaataccctcctctgtgccttggacatgcacctggttgtatccatctagaagctcaagtctgggctgcttgtcttccagagagattagctatagggaaatggggacatttggtctctggcctctccctttctcctttaagacaaataaaaagaggagtaataggagataccccatactttcaatataaacctgtaggaaaaccatatcctaaaaattttgagggcccatctaaaacttcaatttgggaatgattgtgttaactcacatgcagtagtattaaaaaatgactcggctgggcgcagtggctcatgcctgtaatcccagcactttgggaggccaaggcaggtggatcatgaggtcaggagattgagaccatcctggctaatacagtgaaatcccgtctctactaaaaatacaaaaaaaattagccaggcgtggtggcagatgcctgtagtcccagctactcgggaggctgaggcaggagaatggcgtgaacccgggaggcggagcttgcagtgagctgagatcgcaccactgtactccagcttgggcgacagagcaagacactgtctcaaaaaaaaaaaaaaaaaaaaaaccccaaaaaaacaactcatatggtttagtaacagactgggcacgaaagggctatttaaaaaacagttgctcctctggcggaaaggaatgcctggagactacttattttatttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagcctgagggaccgtaggagctgccctgcagagcccagtgagacactagttaatgcagaaaaaacagattttacttggtaactactgacaacatgagaaaaagctggctccatgctgatttgtctagatgtgcctggagtttaaagggagagtgagggagtgggaaggggtggggactcagtagagttagggaaacagaaaatcaccaaaactgggaagggagggttggcccctgtgaaaccaactgatctgggtttgccactggggcttaccgaagtcaggcccccaacctcccacagagactgggagacaggggccccatcctcaggtgttggctggaacacacaggaaattcttgtggcagccttgaacttctcaggcaggcactttagagggggctaggatcgttctgggaatgtggccttgagctgttaggagctatgttagtgttcgttccagcctagataggccagggtgaggcccagtggagaaggggactctaaggagcctggctggagtgtggggagggagggtctttgtcagcactccccctgtgcaagaagagcagagacctgcttctttcctctcaacagtccccgtccattttctgttctgtgttgtgttcataaactaccagcgggaccatctgttgagacttggtagcaaaggatttttgctggatgatgcaagcagtcaagcatttaatgaggaaacaaaaataacaggccaggcacagtggctcatgtctgtaatcccagcacttttggaggccgaggaggatcacttgaggccaggagtttgaaacaagcctgggcaacataaagaccccatctctacaaaaaatttaaaaattagcccggcgtggtggcatgggcctatagttccagctacttgggaggctgaggtgaaaagatcgtttgagcctgggaggcggaggctgccatgagccatgatcttgcctctatactccagcctgagcaacagagagcccctatctttaaaaaaaaaaaataataataaaataaaaaaataaaaagaaagaaagaaataaaaacaaagatgaatggagctgttgataaacccagtttttgagcctacagggcagcagttgaggtttctggccgttgggccctaacaaggccagcaggggcactcagggacttcctggtgtgtggtgtgaagtctgtgatgatggcataggcattggtatcccagttgtggttactttctggagagagcatgtggcatgcaggagctggagggggggtcttcctgggcggcctgtgtagcagcagctccaggcacaaaggctgcccctggagaatctgttgtggttctgagttctttcaagtttatatcaagttttccggcttcagtctgcagggctgtttttttcagatcctgggggcaaagggcagctacaagaccacctgagtcccaatagggatttgagttcttggtgacaccaagtcagggaggagacaaattagaaatgtcagtctgaagagagtggtaggtagccagatactgaaggaaagtagatgggaggatttggtaagggctgacgtgtaggaaggcagtgacagtccaagtgacaggcagatcataaaacctcaaggataggccgggcccggtggctcatgcctgtaatcccaagcacttcgggaggccgaggtgggcaaatcacccgagtccagaagttcgagaccagcctggctaacatggcaaaaccctgtctctactaaaaatacaaaacattagccgggcgtggtggtgcactcaggaggctgaggcgggataatcgcttgaactgggaggtggggggctgcagtaagccgagatcgcaccactgcactccagcctgggcaacaagagcgaaactccatctcaaaaaagaattaggccgggagcggtggctcacgcctgtaatcccagcactttgggaggccgaggcgggtggatcacgaggtcaggagatcgagaccatcctggctaacacggtgaaaccccatctctactaaaaatacaaaattagccaggcgtggtggcgggcacctgtagtcccagctacttgggaggctgaggcaggagaatggtgtgaacccgggaggtggagcttgcaatgagccgagatcacaccactgcactccagcctgggcgacacagcaagactgcgtctcaaaaacaaaacaaaacaaaacaaaacacctacaaaagacagtgaactagactaggatctgataactcccaagggggtgttatatttctccactgaagcatagcatttctctttacaaacccttcccttttgattgaagataatcaaagtgagattattcttatttaccaaataattctggtctcattaaatttggcctgattatttacataaatgcagcacgaacagtaattgaccacacaggcctttttaagtttgctgaaacttttaatagggaatcttagattgagctttttaaagccttt[450 bp omitted]aaagataattgcttcaattttgtttagagaagtatcatttactataatattacgagtcattgataggttaagagaaaagggaaaggtttctttctttttttcttttttgaggcagagtctcactctgttccccaggctggagtgcagtggcgtgatctcagctcactgcaagctccgcctcctgggtttacaccattctcctgcctcagcctcccgagtagctgggactacaggtgcctgccaccacgcccggctaattttttgtgtttttagtagagatggggtttcactgtgttagcaaggatggtctcgctctccagacctcgtgatccacccgcctcggcctcccaaagtactgggattacaggcgtgagccaccgtgcccagccggggaaaggtttctttttttaatattcagaaaataaaacataaagagccaacaatattctgaacaaaagtcataaaaagactgtaatcatccttcagcagtttactcagttgcatgcaggtactgaattcttgttctgcttgatcttgggctagcaggtacatgaacccatcttttctcaaccagtggagatcctggctcagtgcagtcatgtgatctcaaagttaagaaatgctgtcacgcccaggtgcagtggctcaggcctgtaatcccaacactttgggaggccaacgtggctatatcacttgaagtcaggagttcgagaccagcttggccaacatggtgaaaccctgtctctaccaaaaaatacaaaaattagccagttgtggtagcagacgcctgtaatcccaactactcgggaggctgaagtgggagaatcgcttgaacccgggacatggaggttgcagtgagccaagatcacgccactgcactccagcctgggcaacacagtgagactccatctcaaaaaaagaaataaagaaatgctgtcagaagcctaccccatggtacctgtcatgggccttttcattggtccctttttgttgaagatgaagcactttgccctgtagctgattgcaagagatttcaggaaagcatcagagtaaaactctaatgacaaaagacttaaaatagtgtagttaaatatctaatgagagatcattacaaaatcaaacgatttacaaggaatgttggttgtttatgacacatagcattttaaataataaccagaatgatgattgctgttatatgaggacatgtcattggcagaagggtattcaccagtttgtgggaactttatacaatatctggaatccttatattaacatttaccaatatgcatgtaactcaaggaagtttaaatagcattaaaaaaaatttttttttagtttttttttttttttttttttttgagacagagtcccactgtgttgctcaggctggagtgcagtggcacgatctcggctcactgcaacctccgcctcctgggctcaagcgattctcctgcctcagccccccaagtagctgggattacaggtgtgcaccatcacacccagctaatttttgtatttttagtagagatggggtttcgccacactggccaggctggtcttgaactcctgaccccaggtgacctgcccaccttggccttccaaagtgttgggattacaggcgtgagtcaccgcgtccggccctaaataacattttttatttgacagcaccttgcatgaaattctgtagggtccagccctacagggtctgtgggtttttctccccgtgtgcagagatgagagatcgtagaaataaagacacaagacaaagagatagaagaaaagacagctgggcccggggaccactaccaccaagatgcggagaccagtagtggccccgaatgccaggctgcgctgttatttattggatacaagacaagggggcagggtaaggagtgtgagctatctccagtgacaggtaaggtcacatgggtcacgtgtccactggacgggggcccttccctgtttggcagccgaggcggacagcgagaggagacagcttatgtcattatttctgtatttcagagacctttagtactttcactaattttgttactgctagttagaaggcatagccaggtacagggtggaacatgaaagcggaccaggagcgtgactgcttaagcacagcatcacagggagacggttaggcctccggataactgtgggcaaacctgacactccacaagaggtggttgagcagagtcttctctaactcccacagggaaagggagacttcctttcccggtctgctaagtaacgggtgctttttctaggcactgacgcaactgctagaccaaggtccgctaagtaacaggcgtcttcccaggcgctgacgttaccactagaccaaggagccctctagtggccctgtccgggcataacagaaggctcacacgcttgtcttctggtcacttctcaccgtgtcccttcagctcttatcactgtatggcctggtttctcctaggttataattgtagagcgaagattattataatattggaataaagagtaattgctacaaactaatgattaacaatattcatatataatcatatctatgatctatatctaatgtaactattcttattttatatattttctttattatactggaacagctcgtgccctcggtctcttgcctcggcacctgggcgacttgctgcccacaaaattcaccattgaaataaacctaattagtttaacatctctcttataaggtcacaggacagatcctttgaggtcttccaggggccctccaggaaatctcaagtcagtctgagatcaagacaatgtcacaggccacatgcagtggttcacgcctataatcccaacactttgggagtccgaggagggaggactccttgagcccaggagtttgagaccagcctgagaaacatgctgaggccctgtctctacaaaacaaaaagttgaaaaattagctgggcatggtggtacatgtctgtagtcccatgtactctgaagactgaggcgggaggatcacttgagcccaggagttcaaggttgcagtgagctgtaattgcaccactgcactccagcctcagtaacagagtgagactctgtcactaaaaaaaatttaggctgggtgcagcggctcacgcctataatcccagcattttgggaggtcaaggtggacagatcacctgagatcaggagttcaagaccaggctggccaacatggcaaaaccccacctgtactaaaaatacaaaaattagctgggcgtggtgccatgtgcctgtggtcccagctacttgggaggctgagacagcagaattgcttaagcctgggaggcagaggttacagtgagcccagatcacaccatggcactccagcctgggtaacagagcgagactctgtctcaaaaaaaaaaaaaaaaaaaaaaaaatttaaagaaactttatacataaatccattcaatgattatgaggtcaattctagccagctttgacctcataacataaaatttcttttctgcagactttcttgaggccaggagttcaagaccagcctgggaaacatagggataactttctgtatccattcacagttgcttttgttttgagacagaatctcagtctgtcacccaggatggagtgcagtggtgagatctcagcttactgcagccttgacctcctgggctcaagcgatcctcctgcctcaccctcccaagtagctgggactacaggcatgtaccaccatgccaggctaataatttttgagtttttttatagaaacagggtttcatcatgtttcccaggcttgtctcgaattcctgggccattcaggctttgtcccatatttttcctctttttgtaattttacttcaggacaaaattacatccctttctttaacaaaaacactctacattctttgcatacttttcatataaaaacacatcctatcttcctcccatactttgtataggaaattgtttccctcattcttattgtttctaggagttttgttttcatatattgattataatttttaaccattagtaaccggtattttttttttaaagagacagcgtcttgctcttttgcccaggctggagtgcagtggcacaatcaggactcactgcacccttgaactcccgggctcaagtaattctccaacctcagccccctaaagcactgagattacaggcatgagtcaccacgcccggccataacttgtattttacaagtaaaactgggaagaagacaattggaaattgtctgtcatttaccagtttgttggcaaattttatgaatataccatcttataatctctagaggtatatcctttttatagtacaatgtttttaagtgccaagtacatgtttattaacagaccagaatacctttagccagtctgtaccatataaaaataagaagccaaaaagtacaaaaagttacgcttaataatgaatgtttcagcactttcttctcttcaggtattatttagatattcaatgaatgtctattatttaacttcacttagtatgactctgaggttgaaagttactgaaaacatcttgtaagcttttttaggccaatatattatcaaacgcaattaacaaaacacaactcactagtttatataagagctagttctcacttttttttttactctattttatatattttttcttttcttttcttttcttttttttttttttttttttttctgtagagacaaggtcttgctgtgttgcccaggctggtcttgaactcctagcctcaagtgatccacttaccttggcctcccaaagtgctgggattacaggtgtgagccaccacccagccctattttatatttttatctgaactgtgtttctggcaaattggacaagttaagggtcacttgctccatgtgaggggaaggctttctacctgtatttgtggataagacctttacgacttgttttgccctgatggatgactacatgtttccagtgagctcagctggttgcttttgtgggtccctgaggcactgcgagcccctgatggggcaggaagcctaaagttccagggaccgtggggagttgaggggctggagggggaagagagaggcctgcagcggggatccacaggtggaggaggccagacttgaagggggtgtctccttcaagagaaagtagggaagtatggaggtgataggaagggagaggcctgagaggagctagtttggggagatctcaagtatcccaaaggagccactgatgttccaaattatccttggtaaagtcacatcaacaaggaaggaagcagacagaggcgcacttgttccttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgtgcagtatggcttacacctgtaatcccagcactttgggaggctgaggctggagaatcacttgaggccaggagtttaagaccagcctgggcaacatagcaagacgctgtctctacaaaaataatttttaaaaaattagccaggcactgcggcatgcccctgtgtagtcccagttactcaggaggctgaagcaggaggactgctggagcccaagagttcaaggttgcagcaagctgattgcaccactgcactccagcctgggcggcagaggtgatcacgccactgcactcccgcctgggcgacagagcaagaccctgtctttaaaaacaaaaaggccaggcaggtgcggtggctcatgcctgtaatcccagcactttgggaggccaaggcgggcggatcatgaggtcaggagatcgagaccatcctggctaacatggtgaaaccccgtctctaccaaaaacacaaaaaagttagccgggcgtggtggcgggcgcctgtagtcccagctactgggaggctgaggcaggagaatgccatgaacccgggggatggagcttgcagtgagccgagattgcgccactgcactctagcctgggagacagagcaagactccgtctcaaaacaaaacaaaacaacaacaaaaaaaaaacagccgagcgcagtggctcacgcctgtaatcccagcactttgggaggccgaggtgggcagatcacaaggtcaggagttcaagaccagcctgaccaacatggtgaaaccttgtctctactaaaaatacaaaaattagctaggcgtggtggtgtgagcctataatcccagctactcaggaggctgaggcaggagaatcgcttgaacccaggaggcggaggttgcagtgagccgagatcgcgccactgcactccagtctgtgtgacagagtgacagcccgtctcaaaaaataaataaataaataaataaataaataaataaataaataaataaataaataaaatgaagcagcagcagctttgttagtgtttgttcaaggcctgataggccaaggtgaggctcagccgagaaacgtgctcagaggagcctggccggagtgtgatgggggagtctttgtccaggctgctgccacggtgggcctcaggactcatggcctgggcgctgggggtggggctgccactcagccttgaggagagcaatgaggaggtcagattccactcacatccagtgcggtctggatgcaggcctggcccagagcctggtccagatgctggggctttgtttttttgttgttgtttttttgagacagagtctcgctctgttgcccaggctggagtgcagtggcactatctccactcactgcaacaacctccacctccacggttcaagcgattctcctgcctcagcctcccgagtagctgggactacaggcacccgccaccatgcccggctcattttttgcatttttagtggaaacagagtttcaccatgttggccaggatggtctccaactccagaccttgtgatctgcctgcctcagcctcccaaagtgctgggattacaggcgtgagccactgcacccagccggctttgtttacagtactcagcagctgccaaaatagtccccattcccaggcagggcaggctcccgggctcagtccagcggggcagatggccagcctgcacgtcaccccactaggcatgtccaggccctttctgcccctccctaaaggcacccctgtcctttctgtcccctccacactgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaaaaaaaaaaaagccttcccctgagcctgggggcctggccccactgaggataccaggcgggggaggctacaggaggctgccctctgcctggccatctgaccttccattctgaccccttcccttccacaccagcccctttccctatgtagggtgcagtctttgttgcaactgctcacctctgccatggtcggatgagagcagccacggacaatgtctgtgcaattgtgcgttttttgttttgttttgttttgagatggagtcccactcttgttgcccaggctggagtgtaatggcaccatctcggctcactgcaacctccacctcccgagttctagcgattctcctgcctcagcctcccaagtagctgggattacaggcatgcatcaccatgtctggctaattgtgtatttttaatagagactggggtttcaccatgttggtcaggctgttcttgaactcctgacctcaggtgatccacccgcctcagcctcccaaaatgctgggattacagacgtgagccaccgtgcctggttgattgtgcgttctgataaagcttcatttacagaaatagcaggtaggcccctcgcagggtgcccagagcaggtgcactgtctcacctcttctcaggtgtcaccggggtgagaggctagtcctctgcctcctccttcctctctgcaggttggagaaatgacagcttcttgtactgggggttatgagacagtggcaggagggggacactcccagagtgctgccagaaagaggcgaggccccatctggatttgatggcatttttattgtggtgttgttttagagacagtgtctgtcgcccaggatggacgacatggtgcaatcatggctcactccagcctccaactcctgggcccaagcaatcctcccacttcagcctcctgagtagctgcagctataggcacaccaccatgcctggctcaatgggtattttgtggccattaaacttctggtcattcctttagattcccagaggctggatggaggtgagtggccagcccctgggtccagagatgagcgcggggcctggctgcagcctgtggggtctcccaggctggcctccaggtgtcctctcagcctgtccacaggcgctgcccaagcgtgtggcctacctggtgctgcctggcctgtctctacgcacctgtactggctctccctggattactggatcgcagtcgaatcccctgccagaatcctggtccccctttatcacaccggatcagccccaaagggcagggcttcttgcagcagttccagcctttgctgggggtttccagccctgttgagcaagccccaggtagggccctctgcagcccccgtgggggacctgtgtgccgagcagagctgccccgtgtgtaaacgcttagaactggcctccttcctgccatctgtgtcctgtttgtcatcacgcctgtggctctatgcttgtctccccgactgggccaccagccctgtgagggcaggatgaggcacgtccaagccacagtggctctcagtgtgcagggtgctgttagcattggttctgtgttctggaatagtgagaacagtgtgccccaaatggccagtggcctttccgagggtcactgcagccgcatgttggccctctgtggagaacggaggatgcacagccatttcagagcacaacctgaggtctcctgagcttgctgtgcagcccagtctttctctccgtggcccctggtagctgtctttctcccaggaggaggagaaagacaccttcctgagcaggaggatgtgggtgaatagagaccaaagtgtcaatcactcttctgacagaggtgatagcagaatgaaaaactgatggaccccagatctttgcaaagagaacaaagtcagtttctagttatctttctttcttttttttctttttttctttttttttttttttttttttttttgagatggagtctcgctctgctgcccaggctggagtgcagtggtgtgatctcagctcactgcaaccgcctcccgggttcaagtgattctcctgcctcagcctcctgagtaaccaggactacaggcacacaccaccacgcccagctaatttttgttatttttagcagagacagggtttcaccatgttggccaggatggtcttgagctctcttttttttttttttttttttttttgagacggagtctcgctctgtcacccaggctggagtgcaatggagtgatcttagctccctgcaacctctgcctcccaggttcaggctattctcctgcctcagcctcctgagtagctgggactaacaggtgcttgccaccaagcctggctaatttttgtatttttagtagagacagggtttcaccatattggccaggctgatctcgaaatcctgaccttgtggtctgcccgccttggcctcccaaagtgctgggattacaggcgtaagccaccacaccaggcccattttctagttatcttttacggattttttaaaatgagcctagaaaccaggtcatataattagtttattttttaatttcttatagagacagggtcttactatgttgcccagagtggtcctgaacgcctgggctcaagtgatcctcctgcctcagcctcccaaagtattgggattacaggtgtggccactgttccagccatagttcatattttaaaggatttttaagagtctcatttcactgatgttacttgcagtatatttatggaaaacattcctgtcttttttttttttttgagacggagtctcactctgttacccaggctggagtgcagtggcgtgatctcggctcactgcaagctccgcctctggggttcacgccattctcctgcctcagcctcccgagtagctgggactacaggtgcctgccaccacacccggccaattttttgtatttttagtagagacagggtttcactgtgttagccaggatggtctcgatctcctgacctcgtgatctgcccgccccggcctcccaaagtgctgggattacaggcatgagccaccgcgcccggccagcattcctgtcttttaaagaaagatgagaccagatgcagtggtgtgcacctgtggtcccagctactcaggaggatgccttgagcctgggagttcaaggctgcagctgcagtgagccttgatcacgccactgcactccagcctgggcaattgaacaggaccctgtctctaaagaaataaaataaaggcagatgaatgtcatctagggtgtgtccaatgtgagagagaatactgaccaggtgacagaggtgatggactctctagctctgcagcagactgctgggcagagaagcttgggcaggcctggcactgaggcccagaagcttcatgctctttagagccagaggtgtcaagcccagctgcctgtgtcctggccgcactgtgaggcactgaggatgccctcacacgtgcatctgcatgtggcgtgcatgtggcaagcatgtgcaggtgctgtgtgggcacgatcatgcctgccctctactgtgctggagaggtaagaccatcagccgtttcacagaggagggaatgtggacctcacgggggtctcatgagcttgcgagccgatggccaggcagccggtgcagaaggttcatccattttgatgaaccgtgaattcatctgtactttattcattttaataactgaatcatacctcattgtatggctctaccatgttttattatccattcaggtgctaacggatggaagggttgtttctacctgttggccattgtggatgatgttgctatgcatattggggtacgagtatctggtttagtccctgttttcaattcttggtatacacctaggagtagaattgctgggtcatatggtagttctattttaacttttttttatttttaatttttgtgggtttttaagaattttttaatatttgtgggtgcatagcatgtttaattttttttttttttttgagacggggtcttgctctgttgcccaggctggagtgcagtggcaggatcacagccctgtgcagcctcaacctcctgggctcaggtgatcctcccgcctcagcctcccaagtatctgggactacacgtgcggaccaccacgcctggctaatttttaagttttttgtagagatggggtcttgccatgtttcccagactggtatgggactcctgggctcaagcaatcctcccatcccaacctcccaaagtgctggaattacagtcatgagccaccaggtctgaccacatgtttaactttttgaagaactaccaaactgttttccacggcattcacaccagcaatgcaagagggttcccatttcatcacatccttgctaacacttgttattttccttaaaaaaaaaaaaaaaaaaaagccagctgggcacggtggctcatgcatgtaatcccagcactttggaaggccaagggggtggagcacttgagctcaggagactagcctgggcaaaatatcgagaccccacctccactccatctctaccaaaaaaaaaaaaaaaaaaaagctgggtgtgcggtggtgcacatctgtcgtcccagctacttgggggggctgaggcaggaggatcccttgagcccaggaggtcgagactgcagtgagctgcgaccgcgccactgcactccaggctgagcgacagagtgagaccctgtttcaaaaaaacaaaaaaaaagcacatttcaaacatacacaaaagcagagagaattcccctcggtcctccggcctgcaccccaccgccccccaccacaggggcattcaaaactgtctttttgcctctctgtaaggtaaggggggactcttgacgctccccagaccacacagccaaagtagggcgatcggatcatagggggtcccgagtcggacactgagctggcgtgcccactctcgagtcctgggaccccaaactaaaggagctgttccttttccccatggagggctgacggggcaaaatcccagggctgggaacatccgagcagctttgagtagcacaggtgggtttctacgtggctttctttaaagggaggcctgattctcggcttttcaggacccgccctccattttctcacttgcctgctctttcgtcctgcgaaactgggcagtggccggtgacagcgcagggtcagccctcggatggccaggtgggcgtgatcccaccctcctccgtggctgggtgggcgtggtcccaaagtcaattggatgtggtcccgcgtccctcccggcccagtgggcggggcctccccttctggggcctcccatcccacaccagcgagcagagaggagggtgggcggggaggccctacggggctggggcggggcggagcggaggtggttagctgtcgggaggtggggtgggcaggggccagggctctgttggtggcccggggcagccagtccctctgctcagggcttcagttcacactcacaagggaatcccagcgctcttctcctctggcggttgctggagggccttgtgaggtggccgtgggcactgtagcccccaggcactgcattgtggcctgggcgtgttggcctttgagcctttggccttgagcacttccccatcccccatggctcttggccgttggggcccagttggccgcagagcctttggccttgagcacttccccagcccccatggctcttggccattggaccccagttggccacagagccgcgggcaggtgggacaggcgggcactgggtgcctccttgcaccagccaggcccagcctgcagagtggagtgggccggtccctcctgccaggcaaaggaagggggcttcgggcccctccctgctgtggcctcctcccctctgctgcctcccactaggccctgggagacactgcctgcagatttatgaacagacagacctagagattagagattcaaaagccaaattcttacacaattcaagtattaacgcagatttggatttataatttgggactccaaggtctaccaagtaatttgctgtttcagaatagcccttttaatttggggtatatatttctaacactgttttttaaatatggagagtaaacaaaatggcccattatctgaccacacaaatactagtagtcattatagataaaccatagcagataaataatagtaaacaaagcaacaggctgtgtcataggaaatccccaccatgaagaaaggagcaaggtggaaagttctggctgcttcaggtctgcatggtccctctccaccatggttccccctgtcatcttcctgccagaataaggacactgtccttagggaagcaccatctcttgttttttccccacgagccctgtgggtcatggcacgtcctgccccgctgggaaacacagtgggccacgggtttccctgcaggcctgggacccttcccaagggtagcagcagaaggcagcacgattcccactcctgcagctgtggacaggggcacccccactgtcactgagccctgcaccgggttccatcacctgctcggggctctggcctttggccttttcctgtgagctgcatgttggccactgtgacctatctgtctcatcatctttttcttactggtttgtgtatgttcttggtaaactagcccttggtcttacacatcatttccaaggtactaaggactcttcaggggaaatacaacttgagcagagtggttccctcctcttgtggttcacaaggtgcaggtgcacacacacatagcccacagggcagtgtggacagggaccaggagactgcccctggggtccctggctgggggacactagtagggatgtcccttggcctctctgaggccttctgctgtctcttctgaggccggaaaggcgaagcactgccctcgccctgctagggaaggctcaggccaggctggccctatccggggaaggggctcaggtatctggaccttggtcatcgccaggttagggtttatgttgatgattatccaaaggcaaaattgatttccacagaaataacatctgctttgctgccgagctcagaggagaccccagacccctcccgcagccagagggctggagcctgctcagaggtgctttgaaggtgagttggccaacggaagccggggcagtgccagggtgggtacagattccggcccggtgcatgggcacaggtctgctgagcacatgtccactctgcctgtgtaaataggccacatggcctgaaatcccctagaagcctggtgtccgcatgacctccccctagggcggagcctctgcttccctgttctcttctgctctgtcctctggtgccctgaggctggcctccaggggtgtcccctctgtggccctaggcctgcctccttgcctgggtgtgcctttctaaaatggagcgtccagcagagagtgggatctcctatgccactgggagcccagggccccatcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattccagctttcaaaacaacaaaaaacaacaaaaacttttctggaaagatccctgtcagccttgtggagtgtggagagggctgtggggagggcatttcagatgccctgaactcacgaggaggcactgaaccctggccgtggagagggaggacctgtagtggccaagggggtgggcattgggagggtgggagggagacctacaggccaagacagggtagctggaggggggctcacccctgacaaaggagcatgatgctggcaattgggtattgatggcagagagctggcactcagccagatgggcttcacttgggcaggaaagacacccacagctgggcctgcgttactgcggccgagtttcagcagctgtgatgtgggtgctaattacaggggcctgccttcatagaaaagtagcaaacattgcagtttagtaactaggaaactaatagttttctcagtgctgcttgcgcaaagctggtaattatctcaaaagaagcaaagtcatgaagtgggaagtcatgaattgggaatgggtgtccttgttaaacgcacatctgcacactcagggctggggccctgtgcccccttgtggagggttaggggacaacctggctcttgtgagggtctagccatcccctcagtgggttctgtgagcatcggaggcacgaggggtgaggggctcaggagcaggttgcaattcaaaatcaagggctgctttgaggaggcctctccaccgggctgctgtagtcaccaagtccagcccatgcccaaaggaagaggaatgagttcccccttaaaaaaaaaaaaaaaaaaagaaaaagacagagtcttgctctgtgcccaggctggagtgcagtgatgacatcatagctcactgtagcctcaaactcctgagctccagtgatcctcccacctcagcctcctgagtagctaggactaaaggcatgcaccactacacctggctaatttaaaaattttttgtagaaatggggtctccctatgttgcccagactggtctcaaactcctggcctcaagcgatcctcttgcctcaacctcccaaagtgctgggagtacaggtgtgtgcttggtctgaggctccaactttttgttgttgtttctcgagacagtctctcgctctgtcgcccaggctggagtgcagtggcgcgatcttggctccctgcaacctctgtgaggctccaactcttgaagggaggagagtctaaggagggtgggccagatgaaaaccacctcagcatagtgtcacctgctcctctgacactgtcgcttctccacggcattagattttcagtcctgctcagacgctgatgcatgtttagccagttctccaggtggtctgagtagctggtaggaggcttgcagtgtcgggcgacaggcaggacaggtgctgccttctttcccctcttgaccagtttcgtaaaggagtgggcccctggcagcctccaaaggtgacccatgctcctttctgcccttccctccttctttcctgtttaactcgtgcaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttgagattgcttgttaacttttgtttggtgactaagtcaaatttccaagacaaggtgactggggtgtcccttgccctggtaggtccttcctccccataggcaaacacttcctctcaaggtttcttgtttatgtgatgtaagcaaacccttttctgatagcatagataggcaagcatcctatgaggtttctcccgatagtggaccccacgggccatgccctatggctgcgtgtccagtaacaactccttccttctgcacagaacccaggcagaggaactctgtgtcctcccagggcccaggcactggtgaagatggggggtctgcaaatgcaggagcttggggatgtccagaactgaccccaaggggcaggcttgttgatgggaggtctgccccacctcagccctgcagggtcaccctggtcaggccaatattgtctccagggaccataccagcaacccctctccttgggtgcctctccctcataggcctgagttcctggcactgggtgttgagggccccattgtttccactcacccagctagcatttattgagcacctactgtgtgccacatgctgttctaagggatggatactcctgagatggatacaggagttgatgagagaaaggtccctgtcctcacggggcccatgttctgaaggtggcacccaagtcttgtacagtcctttcctgcaggagtcacgctgggcagaaagtggaaacctggccccaggggctaggcacaggcgtggtgccgtggcctagtgaggagcacccatcctggtttggggcaggttctctgggcacctctgaccctcacctcccccaccccccggtctgtttgcaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaatgctttttctcagtgtttttcttctgtttctgagtcacgaacagcaggcactgaaagcagtcccccagccactgccgaaggtcagtcccggaggtgctgcccaggctccaggcagatgcggcagccccggccccagccagcatgggctggagaaaggctctctactgcacaggggcctcacgtgactgcagggctctggggaggtggggcacctgtagcctgacccccaccttgctgcttccaaagcttccttgcccagggctgggccttgtggggcaccccccacaccgtggtctgcctgcctgcagggtgcccagggagaccctccgcctttagaagtccaagttctttcccagccccctccctgcctagctgcctgcccctggcgccagacctggcccgcaccactggggcactgtgttcccaggggcaccctcctatcccaccagccccaaagcccagccaggcacccttccctgccacctccctgggccctgccccagcagcccagtcggcctcctcgggccttctgtcactcgctcacacacagcaccatgtcagtaaacagctaactcaggcctagggagttaggtaggatggggggagtggggtgggggggcaggagggtgtccccaaagtcaggcttggctggggcgaggcgctgccaacccctgccgccagggggctccaagctccacggcacgatctgctcagggtggcccttcttccacgatccaagccctaagaacaagaggctgggcctgggccctgcagagggaaaggggatggtggacgctgcagccactgagtggcacaggaccacgtgtaacctcagggcagggcagccaactccacaggctacatggatggagatgtggatagaagcatctgccctgggtggtgtgggctgaccccaagggtcttggcaccagggctgatcctgacttgctggtccccgaagggcgttggagggtatggtgcccatccctactctggtcccatttcctcaggcccctgatcccacagtgcctgggacagggctgtgggcccagggagcaccctccctctctgacctctgcctggtctttccgggaatgggccactgggctgctggactggaggccaaagtcctgcggggaacgtgcgggaagagcagagcgtgcaggcagcggagactaacaagaagccctggcccagagggcaggaacaggtggacgaacaaccagatgagagaacgtaccaggcatgcaagctagacccaggaatcaacgggctgaggcttagcgtcccctacggcgtccaccagcctgaccgcgggcctgctgggcccggggggaggggccttcctgctggggtcgagctgcagcgcacgggtgggcattagaggcacaatagagcaggttagttagagctcctggggggacagggcaggggcagggccgaggctggcgatgtaagggttggcctgccaggacagcacaggtagcaccaagggcgcagggagccggaaacgtgtggctcacacgggcccagggcgggcacgtgcacacacacaggcctgcacaggaagccaggggattggcacacagcaggcagcaggtcctgccatcgctggtggaccctggtgggctctcacacgcacatgcacagaagggtgcacacacactagctcacaggctctggcccatgcagggtgtggccgggcagtgttgtccccagtgggtgggagctgcaaacttgtcagtacccacagactgactggcgtgaaggggctgcttcctgggcttggccccacaacccagctgtaccccagggcccagaccagacccagcatggcctaggctgctctccagcaacccctagacacggggcctcaccggggacctgcccacagccacatgaccacttactttcaagggttccttctcagaggcctctcctgcagagctggcgccccgtggcctccgctccctccggtccaccgtggagtatccgtctgtagatggggtaaggtggggcatgaggggcgctctgagggaggccctgtaggagcagatctccctctcagcccagacacaggggactcgtgggacaggggctttgggagacagcccccacccaccctgtcctggagatccaggctggtgccagctctcaccaacaccctgccaactctccagactcccctccacttgtgggtcagagcccctggctgagcactaatccctctctagctgccctgtacctcaccctctaagcacccctaaaccaaatatctctcctccacccagcaccatctacaccccataaaaccagcaggcccacttcaggccttggtcccctcccggcacagaaaaccaaccacactgcatctgcactcacctgggcccagcgcatccatggggatcacatcccggctgccagttttctcgccctctgcaaggcaggaggaggagacgggctgcatgtggcagccaggggggatcggggcagagaagcccacacagggctggcccaggtagccctagaggctctctgtcactaaggtgcccaacctctgccagctggcagcctcaccccagcttgacaacagcgcggatgctgtgggaagggagtagccaagaggcagagggcagggaaagtggcctatggaagccgtctcagtgggaggcctgactcctccttcaccttcacccaagggtcaggcaactggggcagctggggtcgccaccctctaggctccctaagctccaccactcaccaaggctcttgtccaccagtggcagcgtgctgtcatcgaagcccccaggactcagtgctcccttaggccccttggcagtagcagcagctgactgagacataaaacacagacacagggtgggtgaagcacatggagtgggaataaggcaaagtgagcagggaatggaaggaaggccagggaagccgcacctggaagcgcgccttggtccaaccatctttctgcaaggtaccacgcagctccttgtagctccacactgtctgcagcacgtgtgacgccgccttcgcttcgcgtaccgattggctgtggggccgggggcggggtcagtggtggcccctcccccacctccgcggctccccaagccaccgaccccgcccctccacacctggaggccacgagagccaccaacgctggcaccccgcgtgcctgcaggagcgagcgcgcgttatccaggctgtcggacacgatttcgtggatggtgttgagcaccgccaccacggtgtcttcctccaggcaggcccccggtcgcggcggagcctgtgcattgcgcacattccgcacaagctcagccatggcgtagctccctgaggggcaggactaggtgtcagaacacacctctgccccacctctccaggaaggagcagggatcccgcgagggcgaggggcactgccaggagagcccctggagaccgcctgtgtgcaggcggtcacaggagcccctgtgagcagggcgctgagcttcagagacagggccggggggactggagctacctccagttgggacagcgcccaagcgagagggccggggcctggactcccaaaccactcatcctccaagcccctccgatgggaccccaaagctgcaggcacagttcggtgcccaggcgtgggctttgcaggcgtcctcaccgatgaggtctttgttgcgccggtccagcgagaggttgcgcagagcgatggcgacggcgcgcaccaccttgtcggtctcagactgcagcagttccacaagcaccggcagcccgcgctctttgcgcactgtggcgcggatgtacgtggcccactgcggaggcggggagagggttgctcagacatacatgccaggcactctcccacctccagacgctgaccgctctctccagctggaccttcctgctcccgtgcccgacaaagccctaccccaaaagctcaacggcacctccaccgaggttttcccaccgtccagggtgcacgcattgcccgcagcccatacacctcttggatcctggggtggtggtgtggcccctcctttccccgccagccgaggcaggagctgcaccagtgaggtgcctgggattccctctctcaggacttgcccaccctgcccgacctggtccctcaccatccagttgccggcactgaggttctgcagagcgccggcggcagcctccagggtgttgaagttccggctctccgtgaggagggagaggtagagacgtaccacctcgggctggtacagcagctcaaagcctaggtgcagggcaaccgccacccacggtcacccagaatctgctctcatccatcatacccctcccgcttcccgcttcagagctcccagggcgtgggtgagctggggccagggatgggtgtggatgagtcacgtaatatttactatcaacatatagtcacccaaggggaaaagcgttcccatttcacagaggaacaaactgaggctcaaatcagttggacctgcctggcagcaggagcatccaggaggcctggggtggggagggaggtgtcaaccaggaacgctctcctagcaacaagacccgcatttcccggtaggtccctgaagctatgcatcctggccacgcccctggtaatagggcccaccctccctggcaacaagaccagcattggccagtaactgagagttgtataaccaaggccacacccctagcaagaggacctgctttcaccagtaactgaagctgtgcagagagctacgccccctagcaacagggcccaccctcccccactgacaatagagcccaccctctgtaagtcaactgatgcagtgcaaccagggcagctgccctagcaacaggaggcactcttcctggcaaccactccaagttcccgggcaactgaggcgccgtcctgctgctctgcccagtgctccagaaatgaggggtcaaaacagccttccaagcttgcctgtctccaaactggggcttcagcctggcttgggtactacctcgatctcccctgtacccacccagtgacatttcatcacaccctcgccagtcctcatgccccatgctccctctactcctgccctgctgggctttctgctccaacacactccaagcacactccccgctggggtatctgcatcagccctgctctgcctgtaatactcccccacagccctcctgcggctggagccctccaccctggtgacatgcaggctcttccaactggctaggccccaccaggacagacctctctctcaagccagatcccagcatacagcccaataggcactgccctgtccctgcaggtgttcgtctggcccagcctctgaacctggatgtgagcatgcccgcctggctcccagccccctcagataactcagctttgtggctaacacaggaggccctgcctccactggaggcgtccctccaaaccttcccacctcttacgcaccgtgaggccgagcaagccctcggcctctctgtgcctgtctcccccaaccttgcctgacatgacccatggcacttcctcccattctaaaccctcagcaggtgtcctggtgctgaatcaccctccaggaaatcctgcacctaggggcctgtttccccatctgttccctgaggccctccaggcctgcttgatggctcaaagcttcactaccagggcaatcctgagcccagacatcccccagtggagctggcttcatctcagcccactcacctttggcggcctcagttcgcttgggcaggtctagcgtgtcaaagttccggtccatctcaccatccttctttcctggaagggaaaggtggtgggaggtgaggcagaccccatatggggaatgggtgtatcaggagagttgggcacagttctctcctacccaggccccaaaaggcacccccatgtccaggcctgggcacctgtgggagtggagcaccgttgtcagagtttgggcagacagtttagcctaggggtaggagttggtggcagtggggcctggggatgtcccagccctgcccctaggactcatctcccaccaggtgctgggagctgtaccacagaccctcccggtggctcccttgcaactgccaggtatgtagactgagggaagccaggagccctggctggatggtaggtggatacaagccaagaaactgaaggctgaccaggacaagactcacttgggtcacacagtaaggcagaactagggggaaactcccccagctggggtcaggacattgtcccaggatctactagccaggagaaaccccacagcagcccacctaacatttgtgtagccctggcttgcacacgtctgtgacagtgagcccactgtcaaccactctccccatgtcagatgatgcttctaccccttcagaaggcagcagagtggagccagatgacctggggtccctgccctgctcaccctcatgggacccttgtatccctccgagccacatgatgccccattctatcagagaaacagactgctccttggtgcccctagagataagtacccccgggccctgcccactcttggctctgcccaactctgcccaggtaggcaagtctgaggttacagaatgagccccgtggccttcccacctgccactgtcataaagatggcagcccgagtgatgaagccaggggtggggcagggccctggggctggaacgtgctcgcctcttcccaggtacccactgcacacgccaggcctggagagcaggataaaaagggactcaccttggtggaaccactcctctgggaggccggaggaagcagaggagagaggagaggagcctgaacaggcagcactcatcacccccccatgccctcccggaagcctcaggttcccactgcacaccctggatcaagcaggcagcatgtggaacctcatcccatcacttctgggcactgagcacccaccaggggtacaagaagagggaggcctggggtcagtggggcaggggcaggtggcgtacaggtcccccacagctgctggggaggtcctgggaacctacaccctgctagtgcagtagagaaggtgtgcagggcatcttgcccaggcagatggggggctgccccacaggttggtggcagtctacagctattctgtgaacagtgagcaggcagcagccatggctccttcccaactcatgggcaagtggaactctccccggagtagaaagactgggtctgggcattggttggtttcccttgtgtactccctgggggtcccacagtgtagatggggaaggttggacctgggtcccatcaaccatgtgacccagggcagtccagcctccttgactcctggcttccctgcctgcctgttgggggctgaccaggtgtcctctagcctccatgatgggctgctgtgggtgtacagagagccttccgctggggcaggagttgagatggtagagatgataccccagtccgccccacccacctttggccttcttgcctccaaagcagctggcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagaggtgagtgggtggggcagggcaccctaggcacagggctggccctcaggaaagactggccacagctggtgtgcatgagggcaccgggagcaaaggaacagggagtcctcagtggaggggagcaaaagggcggtaaccgccaggaagggtccatgggaggaagcctctgccctcacggcacaccttctgcctgcaggacggtgcccacttcagtgtggtcactgcgaggcgggccacacccagaacgccaccccagacccacaagcccattcccctgtgctgctcccacagttccagcctcctgggacctgcatgatcgtctctccagcccttggtatgaggctgtgaccgtccctgcccaccttgttgtcagtgtccttccggcccacagccgactgcagggcatgcaggagcgcgtccaccagcccttcacactcccggagtcgccgccgggcctcagcaccatcggagctcacattcctgtgtggccaagagcaggccaggtgacccctggctaccagaaactccctggctccaccctggccttgtgggcttgtcttcatctgcaaaataggccctgctgctgccctcctagcactaatgggaaaggaccccacagtctggagctcagtgaagggggagaagctaactgcccccaggcctcaggaggggagccctggcagacaactatcttggctggggatagctgggcagggaaagacagggtttccctgcctcccagctgacctggaaagggacaggtgcactctcagagagacctgaacctgtgcaagggcaattctgggtccctcgccaccccaatggcagctctgggccccaccttaccccaaggtcaagagcctgcagggctgcgcgggaacaccctgatggacaagcaggactgtggggacccaggactctgtggggtcagcagggcctcccaggggtaggaggggaagggcagaggtcacaggtggctgggatgagcctcccaggcagatgaacaggaaggtcccagctccccctctggctgtcaagtgatgggaaggtaggtgagagctgggcagggctacggtaccacagagacccctccagagggtgcccctgggaagactgggacaccacttgggggtgaggacagctccatcaggccccacttctcatccacaggacttgtgccacagctctgaagctcctaagctctggcgctcctaagctcgccgccatcttccacactatctgggaccacgaggacggggcctggtgtgcatgtgggctttagcaccaggtctggtccacacctcaggcagcccgacgtgttcttgaagacagttgtccactcggcgtcccgtggcttggagtcctcgttgggctcacgctcccatcctgagtggggcacgatcacctcgtgggtcagcgtctgcaggccatggtcaatgatgaccatcttcaggggctcataggatgacaggttccacagggtgcctgtggggtgcgattggccaatctgtgctgaccatatgcaccgcctgcctacctccccaggtggccacgctcaggacctgtcccactctcctcatgtcccagctcatgcagaacagtaggaagtaacaaaagccgtgagtggttccgggggacacccagtactggtttccagctaggaaggagccccaaaggggaggaggtgcagaggagggtgtggcagtgctgtcccgtcccacccattccctgccatgtggcaggtggcactaacactcctgaggccacagggcctcacagagacacggtgaccctacctgtccctcagctctcacaaggcacaagccccaccactgcacggttggggtgggaaccaaggaggtgggtcccaggagagtttctgtgggggcaggaggtgtgaaggcaggaggtgaggggacatgcccgaggggcgcagcgtcagcctccctgctatggtagagactggggaacctgtcacagtgtctgggcctgatgcctggctcctggggcaagcgtctcagcagctgcactcctgcctaccgggtgctttcccaggcggtcgcaggccgagtggcctcgttcctcccgggttgagcctcacactcttctcttcccaggggatgtgagcatggccaggtcccactcaccagtgacaagctcacggacctcgttgtcccgggcagccctcagcaggcgcaccagggcaggcacaccaccgcagtcccggatggcggccttgttgtcagtgtcgcggccataggagaggttgcgcagtgccccacaggcccggcgccgcacctcagcccgcgggtggtccagcagtgccacaagcagcggcagcccccgcaactgccgtacacgccgcttgacaccctcgttctcaaagcacagatgctgcaggtaggcggccgcattggccttcacggggtccacggggtgccgcagcatggccagcacctcaggcagctcagggtcccgccagcgcggctccttgcgggcgctatccactgagggcgagcgccgcaccagccggtccaggctgcccatgctgccccgttcaggctgggccaggggcgccgtcaccattgggaacgcaggccgctcgtccgccagctcgccgccatcatctgctgtgtcctcgtaggccctgcacaggcaagtggggcgcgtggacatcgtcacagcagccgccagccctgcctctgagctgccccatcacaccttcttcaggactgcaaactcacccagcagcgctgggctgagagcacctgtatcttggcccggagcatggtggggacacagagagtcatgcaccagcccagtgagaaccaattcagagccaaatgccaaaccccagccagcggctaccaggacccaggcaaccctcccaggacagcaaactcactcactgctgtcaccgggcagtttcccaatcccgagcaaaacaagtttctgtgagacatctgctatggctgctggagagaccgtctcacctcccttccacaaaaccaccccatcttccatgaggcccatctctggctgtgccaggatgtagggggagtaaatggccctctccgcatgaagccatcccagtaggaccacctgaggagtattcaggccaccagccccttggggcacaagatctccttagctctcagtagccctgtgggttgctgtcatcaaaccgcctgccctgaggctaggagtgacggtcaggtgacttggccagggtcacacaacaaaatcctgacccgggctgtggtcacatccccactccagagatgcagaaactgagggcaatggggacagaaccaggggctgtgacaagggccagggctctgggttctggttacccagagtgtggctggagcaaggccagtggccggcactcttcccagctttcctgggccctgggcctgcaggacagtgcccagccgaactcctaccaccccagggtccacctttcttctgtccctgacgagagccaaggccaattcaaactaacatgcatgactaactcaactgcgccacttgacaagtggggcactctgtagttggggggtggagggcagacttcccagaggaggtagccacaggggacggggtgcagctcacctggtatgaaggccccgcccacactcaggcctcctccttgtggccgtgccatagtcaggctccagctcagggccaccctcgtcatcagcggccaggctgcgcgtgtcatcctccaagccatacggctctgcctggaagcgctcgggcagggagcggccacctggtggcccaggctcaggacccaccgggaaggcttcccggtggccaggcagtgtgaagcagccatcaccagggcctgggccaagggggccagcacgtgggggccgcatgcccagccctcgggacaggctgccatagctggggctgtcccggggctcggggccttcgggaaagccacccccactgctgaggtaggctcgagagagtgtggccactgggccaccaccacgcagcaggaaatgccggtccagggcaccatctgcaaaagggcctagtggggggccgccatccagcagggggagtccatctgggcccacgggcacctggcgtactgtccgagtggtcaccgtcttgacagtcttggtgacctggtggatggataggcaggtaggtggggtagcacgagaggcctagaaactgctttgctggggtctggctggccttaatttcccactcgagcaatgagaggccccacgtggcaagcttccatgtccactctgcaggtgggacagctgcagcagcctggccctgctcacccacccactgcctgggcctggccataccttggtctcggtgcgccgggttgtgccatcttcggatgtgacaatagacacatgggaagtgggtgtgccggggtcctcctccaccgtcacggtctcctccagcacatcaggtgcctccggcatcgtggccagtgaggcctggctgcctgggctctgctcctggggcaaggagggacattggtgggcaggcctgctgctcagtcacccctggagtgcaggtctccacacacagcagctctgcctcagctcatgctggccagcacaccagggtgccttcctcctggtcctgaacccacccaccccaaggcctgtttcggcccaagctgacaaggacagcaataagttcttgccctctgaacatcgaggtgctaaccctgccccggcaccccatcctggggggaccctggggctggacccccatctcaggtctcctcaggctgagttggcagataaggacatagaccctggggggtgaagtcttcagggccctccccaagctgcatggcctggctgccacaggctcctccaggccccaggaggtgccagtgagacctgcagcatgccttcctgatgtcaaccaccacccctagctgggacatcatggtgtcctggggcctcctccctcacctgccccagacaccttgagtatagaagccttgtgggggctgtttcagcactgcctactgactcctgtggccacactaaggttcccgccaccaacgccagccagacgccctcaagggacagaaatacgcagttcccagaacaccccatgcacctgcagcaccagtatgtccttattccttccagcccagacattcttgagtgttgtgtaggcacaggtttgccctacctcgggccagtggctggcgcccccagtgactgagactctgggcatcatatcagagaccagacacagtagatttgagcctatgggtgcccttgccaccattctgcatggggtgacgacactggaattctaggcaagacaactctggactgagacttttctatccacatgcctactgactggacttgccagtggggaaactgaggctcaaagaggataggctggcccacatcagagccaggcccaacccctgccgcgctgagtggcttgaggacctaagactcacagcctgccccgggcctctgactgcacaggtgcctggccccagggccacatggcaccaacatccggggatcggcatctagccaggatgggcaggagctgaaacccaagccctggtgggtgggtcaggcggagcacattcccaggcagccagggcagggtcagcaggaggacaggtcctgctttgtggcccaggcccctggtccctgcacaatgggtcccttgcctgggccccctggggcctgcacagacactaagctctgccaggctccagaggcagactctgcccattcttgggcctgggaggtgagccaggttagatgctcagcgctgccctcaggacctgcctgccaaggctcgtgggctgggaagcctccccaggtcagggtcctatcctgggggaatacttgacccccaaatgcatgcagtgcaggtgtccaggaaggggcctgcaccaacatgttaggacaggtgtatccctcaggctgacagaggaaagaagtggccacagaaggcacctccccctctcccacaggcagggtcttggaggatgacagataactttatagatggggaaactgaggcctggcagggggaagaggatttacctagaacttcacagtccaagtgggatttcaagcacccccagagaaggcaatctggcaaggaaggctttgggcctcatctcgccctcagtcttgagatgtaggtggaatgcctgctgtggacctggctaggaaaaggggacctgttccctgggaaaaagaaatagactgaggcctagagtggggacaactggcacgctgccaggcagggcaggctgggctcttctccaaaggcactggggagctgggactgctctgaagcaggagaaggcttgtgtggcccatcactgctggggctgggctgccccatctgtatctggcaaatgtgtgtcaggccctgagctctctctgctgggccctgggcggggctcatctgagttcaagcaggggcccaggcactgaggggctgcagttctggcgacagagtgaggagggtataaagcaagactgaggaaacgttacccaggactctgccagtgggatgtagcccctcatatatgtatatatttacatctattaaaaactcagagaaaaaccccctcttccctagctaggcagtgggggtaagcgggagaggaaaaggggaggacatctcaggaccccgatgccactctgtggcccagcttatccctcccaccaaggctgtggtgagggtctgacaggcagagctggggtggtccaggagagccacgcccccgcagcaagacctggcaaccctgcggcaccacccatcagccccggcctagcagccccgcagtaggatccagaggccccaagagtccctgctggcaaatgacctcagggagctaaaaacgagggatgacttcacccgggtggcaggtgcatgagtcagccagtgatcacaggaaagcccggcccctgctacacatgcccaggcacacacacatgcatatacatgacccctcagacagggacacatgcatgtacatacacgtgtgcaagtacccagcccggcacaggccgagcacatcaacccgtgtgctctaacagcaccccaagggcacggcgcccactgttcccagaggcacactcgtgagcacacatcctcccgtcctccaccgtgtatcggagacccttatccatgcagggcctcacagagtctcaacacacagggacaggggccaccaactctgccaatcatctgcccagcatccactctgggagtctcagagctggctggcagatggagaaactgaggtgtagagtagtgagaggcccatagccagctggtggctcagctctctgcaacatctttagggtggggctgtggaatggtgggctgactctcaacaggagttggctgcagtccctggatccctgtctggccccagtgtccatgtctgacgtgcacctgcccaggctggcccactctcagggaccctggccctgcagccccacacagcctctgcctcagacccaactctgggctgctcccctctgtaccctagacatgggctctaccctgaacaccccacctccagcccaatcccacatgctgcatcctgtcagtcgtctctcatcaccccctccccagctggggccccatccttgctcctcttgcaccccgcccggcctcccagcactcatccctcccttggctcttcaatctctggtgcaccaggtctggggcccccaggactggcccagaaacaggctgctgcccaggcctggggtttcccatgagctcccttgggcttgtgggaggggccagagtgaccagggaggtagaccacctacccctgctcacaagagggtcccgggaacacagggctgagcccagcataggggctctgggccccatcacgcaccttcggctcagcttcttcacaaggaggtgagaaggacagagggggctggggtcgtgggacgtgctgggtagcatcagtctcacttttgtggcaaaatgcaaggaacacagggagcagaaaagcaagattggaccaacacacagagggatgctggggcacaggtggctgggccctggtcccatattacttatctacccaaaccaccggacttcacagatgcaccacggtctgtgtcctgaagaacagactgcaggggcaggcccctcccctgtccaaggcctggctagcacacacagagaatgagttaaggtgagattgcacacctggatcccacacctgcaggccaggctcccagagggcaggaggtggctgctgtccgatggatgaatgaatgaatcttctccatccccattatggccctcccaggtagagtccaggacaagccaggctggcatctctcaccaggcagcaagcccttggccaccacaaaatgccctttcccttggtgccacagcctctgaccagtctccaagacctggagcttacttctccacacagcagtgcacctgccagggcgtggccccaggcagagatgccaaaaagccaagctgggggagcaaacttggggtgggagagcagggctgactgtcatccacctcagcttccccaagctcagcttggggtcatcagacacactgtgaccatggatttcccaaaaactggtccctccacctctgagggccagaccctgggggccacaccagggccgtaggacaggcaggggcctagttgcccaggtagcaggtgtgtgggagacctgcctcccaccacagagggtcttggctggtctctcctctgctcagtttccctgcctgttactgaacccagcactgctctgagcagaggacaaactgcctatgcctccccccacctcaatgctgagagggggaggatcccgttttccttagagatctcctccagcatccattagtgggcagggcctgtctctatccctcccatcacgtgcgcctcggaggcagagaagacttccattaaagctccggaagctcctttgcaggtcccgggagtcagagccggcgtagggggtgtggaggggagaggaggaaccctctcagggagcagaaggcctacccgggcttccctcttcagacttcagcctccttcctgcacagacagaagccgctcaggaaggccctggctctccacccgtgtccccaggcacctgtcctgggcgctggccaagaagcgtccatccggtccgggccggtgccaagaggagggtcaaactgccaggggtcccgacccccccaggccccgcggatgggctccagagaccctgcggcccgccctgcatacccgggggcaccgcgctcacaccgccacccgcccggccctggccccagcctgacgcagcccagccaggggcgcaagacaatagctgcctcgggccagcggctccgcggaacaaaagcgggtcctcccgggcaggccgacgccccgccctctgcctccgaccccgggccagggtccccccaagccaacttccctccaacctgtctgagttcggccggcatcgggccgggactcggggggcgctggccagcagcgggggaggcggtggctggaccaggctcggctccggcgcctcggccgctcgggctcaggctcggcggactcgctccccgcgggggcggatctggcggcggtcacggcgagcagccaatcgggcggggccgcgcccaggtggggcgtggcgggggccggggtgggcgtggcgggcggggggcgggcaatgtgaggtcccgccccccagagacagggggcggggccctgcagccccgggtcgccccctgtccccccacttcccaccacctccccccacccactgccggcctggacttctgctccctccccctccctgcggcaggggtgtcactttcccgccgaaagactttggccaagtccttcccaggcctcggtttggcctcggtttatgaccacacttcagtccgcctgcaaagggggaaacagttccggcagggcaggtgcccgtgctgcgatgcacagagcacaaggcctccctcactggcacaaacctggctgcgactcagtttcacctgccatgaaatgggggccgatgagacagtagtcacggctctgtgagatctctccagtctcccagatcccccctcaccctcctgcccagccgccactctgaatgggcctgcgaagaactgtccccacagagttcgatggggacctggaaaagggccctgcaggggacccccactttgtatcttgggttctccccatcgaggcacagaagccccgaatgcacccccactgctcccccaggccagcctcaatgtgggccacaccctagggaatctagttctgctgcagtgaaaaatgggaggggaagggccaggctggagccaccttcttatgtcaaaccccacaaaggccaagccaatggctccagcatcacgaacagggaaacaggttctgagattaaatgagctgagaccaacccagggagactcagtgggtctggcaagagaaagggctcgggcccaggcctcccactggcttctccgcagacccctcagaaaacagcctccgcagggaccactccctgctgccctgagcgccatatacagaggccactcggctagcatgctcaagattctaggtacccaccatgtgcccctctgagcctcagttcccccacctgcagaggggtgagctaccctaccactggctggacccctgtatcttgcatctagggccaacctgcctggaacccctggagcagagcgcagaagaccagacactgcgccaaaaacgcgcccgcatcttatctttaagctggctccatcttctcaactgcaccagcagctagtgccccagccacctatccacctaagacgagcccaaggcaagttccctgatggcacccctccccactgggtgggcgtcagccctgtttcagctggctgtctagaggaggggccccttcctgctggaagatgaagggcaggtagccaggaccctggagcagcccagtgagtgcagcagcactccccctagcctggttccccagcctcagcccccagctacctgccttgccattgccctggcttcccaaagcccgggctctgaccctgtggctcagcaggtagatcgctaggcacttcctactgaaaccaatctgggaaacctggccagcccaaggaggccctgcctcccctagtatcctcatcagcccagccagttgagctgcagccctggcaacacatgctctcttcaatcccagcctgagaaaatcaagggtagggggtcggggggagagttcaggggcaggggtggtaggtggaggggcagtagcctgaggtcttgaagtcttttgcctgaggaggtcagggtagctccaggctgtgggaacatcttcccaccagggcatcaaccctccggggtgccttgggtcctcccacactgcctgtccgaggacagttccggtctgggagggttggactgagcacactggcgcctgagaggcggcctcggggtcactggcttccactgtccctatatggcccagctgggcccagcgttctgcttccccgcctcaagtttgagggtagaggcctcacattttggagtatctcaagtctgagggctgtgagagtggccccagcaccgagacccaccagaggcctctgagcaccaggggccatgaaaaagggccccctagtgagtctcggaccctctggggacattaatttgactctcaccatgcactggtgctgggctgggccttctatgtgggtctcatgagcagacgtaggaagcatgacgcctgctggccgacaccaagtctggacaccaagactcaaggagtagtcaccaaccccaggtccctcggcctgacacaggctgctggttctgagccccacatgccccagccaggtgaggagagcccatggggctgcctcaacagagaccagcgtttgctccctttctctctagatgagaagggccaggctgccccaagctcctggcatgtgtgtgccaggcgcaggtccccagagtcagggcccagcaggaccaaagaagggcgggtggaggtgcaggtgctgggagtatgctggggggaggtctggctgctgggtttagcggggcagggagctgagccagggagacaggactctgcagggagagccctctagggtcactctgtgaagaacccagaggccgcagcaggaggcaacccccccagcctctaagctgggtggtgaggagagcccccttccccgtggctgctgggacagctccaccctgactccccactgtgctagccctcagtcagtaacaggaaccatgataatcacaccacatcccaagtctccctgcatgtacttgttccggcctcctaaccccaagccaggggctcttgctgtttcatctacaggttagagcactggggtgctgggaatggggtgtcccagtggtctaactgctcactgcataccccaactttagagttcttagggcctggccatggaacacagaaggctctatacctcctgaggctgagtaggggccggagcccagtctgaggataatggccagcagagaaaatgaggctcccaggtcagcctctaagctgcaggcagagctctgggcctcctcctggggctgacccaccagtgcatgcaatgaacactgtggcagggttaggcatggtgcaggcaaacccctaaagtgtctctaggcagaccaaagagctgcccagaacagaccccatccagctgcctgggccctgagggctcagtggagggtgctgttctgagtgttgggctgtgtcctgcccactcttcacatggtgcctagtacacccaagtgggacttccagcccaacctgggatcccattttcctttcctccccaggagccccagcaaatcttgcaataagcgagcgcatgctggcttgtggtccaccaggacccactgattgttttcccacttggcaattttcacccttcccaagtcactaggctgttacctggaggaccagctgttgccaggccattggcaggggctgcccactgcccatgccaccactgaccatgccaggctgctgggcacgctccagctgtagggcaacatggcgccgctcctgctccagtgcccgtgtcagcctctcgaagcgggcctcctgctccttcaccgaggccaggatgctggcggccgagtgcacattgcagtcctccatgaccagagcgcccgccagctgcaggcaaagcagagtaagctcagtggggtggggcacagcctggcaaggccatcatgggcccctgcccgccccactcacagaccatacaactcactcccagaccagagcatccagccctctagagggaagcacactgattaaattctaaattaaaagccattaatccgaggctggccggaagcagccggctcactccccatgggttttgggactctaacctggctcctctgcttcctgctagacctagcagaaacatgggccgtgggcggcttggagcccgctgggaagggcaggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcccagcttgccccctggctgcccagaatgtttgtttttcatgggtaaaaagaagcaggacaagtatgcggagctccaatccaggctcaccacagtgggcagggcatagccacgaggccacactgcccggagcacagtgagcatggccgggtgcccagggctgctcaggcatcctcctgcccagtcccgccagcccactgaggccaactccgctggatcccttgcccttgcaccaatatagggccctccacggggaggacacgcactgcgggtgacatccccagagcgtcagcactgctgctcactggtctggatggagccagctgcaaggacagagagcccccaagaggaaaagcagcgctgggctcagctgcgccagcaacacggtgcggggacatgggtgcacctcataggtgaagagacactgtggagcccagccccaccgacagctgggaaaacaggcccagcaagagcgagagaccagtgcaggcccccaaagctgctctccatttccccagcacctgtcccacaaatgaaactgtcaacacaacctttcggggaagccagcatgagtggaggagctgttttaagccagccacagaatggaagaatgcagggagagctgggggccgccgcccgagactgaggtgcagactgggcgctccagcaaagggataaacagcactgcactccccaagcatggtcacacagctcttctctacacacctgatgctgtctacccacaggccccagacccaacacaggggagccttgtgcactaatggactgaacctagtgctaggcccgaggtgggaatggtagggtattccccctgggacggccagggcggatggcagggcccatatcactccagccctcagcccagtcctggctgcagcaccagcccatctcagccgaacctcagaagcaagggacagaaggaaatgggacgctgccttggatggcaacaatcaggaccacaggatagccactggcctcatggacctggggtggcttacttccctccctgtgcagagacatggaccctcgtctacaccacacaccccatcccccatctagcaggaccaggcttgggctgcagaccctgcggacagcttccctgacctaagcccctccagcacaccctggctctggggactaaagatgcccaccctaaagggggcccactggctctggctgagggctcagtactccaaggccacagtgggaaggtgaccaaaccccacgatgaccttctcattgccgaacttggcttgattggtgcaaaacaatcatgtatctccctggaaacatccagaaacactggccagtgttgtggggagagtctggcagccatgctcaggagagcagagaccttggtgctgggcctgtgccatctgccccagccgcagggtgcaccctgcatttgccctggggggaagtgccctaggcccgcaggtcatggcctcggcatctcaggtgtctcaagagcaacccgggatatgctccaggcagagcacagaaggcccaggcccactcccctgacatggtggactctggcctatgacaggagccagtctggatacaagggatcctggcccagaaccaaagagggctgcttttcagatggtaactcaaaatgctgtttttatattcaagtaataaatatatgatgtcaaggaaagcaaaatgtgcatggattcttaagatcgatggggcctgagtggatgctgggcagagtgggcaccggatttgcttttgctagagcccaggagggccctgggggaaggctaggaagggggacactgcagggaccttggctgtccagccaatgccaccttggcctcccctaacctggtaagggcccagcattgccttgtcgggtggacccctcatgaccccccacccaaaacacagcaaccagcttcatgcccaactctgaggaggccacttcttgccaaacatgctggccccagaagtttacttagccgcaaggcaggaatgacattgcacagcccacgagtgaccagacttcaggaccatgtggacaacaccatgttccaaccagaaaacatcaggaactgaaggggggctggaaaggtcggggctaaactgaaactctgaaaaataaactgcaaaacaaaagtgacgacccagcccccacccagccccagccacaatggacattggccacgtacccaagggaatccaggaccaggacgtgagcctccaggtgctctcacaggacaaactgctgggcaagcaggtggcccgaggagagaagcatggcaggagaagagggtggccccaggcacacagcccatggaagactagagggagggcaagcaaaggagagacagcgaaggatggacagacagatggatacaggggtggatgggggatggatgaatgaatggagggtggctggggcagtggtggaggatggacagagggacggacagattgatggacaggtcggaggatcgtgggagatggacagagatgaatggatggatgggggatggtggggaatggacagatggatgaatgaatgggtcggggggatgctgaaggatgaacttatagatgaatgaatggatgggtgggtggagggatggtgggagatagacatacagatgaatggatggatgggtgggtggggggatggtggaggatgaacaaataaatgaatggatggatgggtgggtcgggggatagtggaggaagaacatatagatgaatggatggatgggtgggtggggggatggtggaggatgaacatatagatgaatggatggatgggtgggtggggggatggtggaggatgaacaaacagatgaatggatggatgggtgggtggggggatggtggaggatgaacatatggatgaatggatggatgggtgggtggggggatggtggaggatgaacatatggatgaatggatggatgggtgggtgggggatggtggaggatgaacatatggatgaatggatggatgggtgggtaggtgggggggaatgatgggagatggacatatagatgaatggatggatgggtgggtcgggggatggtgggagatgaagatatagatgaatggatggatgggtgggtaggaggatggtaggcgatggacagagagaaaaacagacgcatagatgggatggtgggggatggatggatgaacgtatggatggatggggggggatggtggaggatggacagacggatggacagattggggaatgaggggtatggacagacagacgggtgaatggatagggaggtggatgaagtcatagaagggtagacagctagatggatgattggatgggtttacagatgaatggatggatgagtaatagatttgtgggtgggtggctggagggatgggagaagaggaggccagatagaagggggtgtaactgagtgagtgaacaagtgtgtggacaggagactaataggtggttatataagaaaatgaggggagatgagaggatgggtgaatggtggctagttggatgggaaggtggctggatggatacgggtggtggtagagggataaaatgatgatggaagaatgtgtaggagggtgggcagatgggatgctgaaggctgggtggatggaggagtggatgaaggagaaaacagagtgcgatgcatgaatggaagggggggtgggctgtgtaagggccggtgggcaggaaggaaatgctggaacctcactaagtggggaaagccccggcccgcaaaccctctggggcaaaccatggtcagcacacactgtcaggaacacgaaggcatggtgaggaacctgagggtagaagctaaatcctttccctgaaaccaaagctgacatttgacgacatcttgccaacccagacattcctcctcgggagtgcggccagagccttgtccggaaaatgaaattatggggcccgagtccagtgtgggttgaggaattagaggaatttccgaagggtcaggccagtgaagggtggcaggcggggcctggctcccatcctgaccccttgccagctgtctaccagaacacagccagggctgcgctggcccccccctcgaggggagagacgggacggatgaccatcgagcctcctcccataccccctttcccctccacccttccctacaaggaggaaatgatgccagaagtgccctggcaggagttggacccaggcccagcacccaccttctgcctgggaggacatcctgggagctgccagcacagagacttcctcgtccccctagctggccaggccttgtgggggccccatgtttaccctgttgcccctactgtggtcagatggtgcccaaagccttgtgggtagcttctggccaagcccactggccgggcactgtactcaagctgggacagggccagagccgggggcctggggttcacagggcggagtccacatccatctgtgccaaggccaggaccacagtcccttgcagactgtgttggatccggggtgcctgggctggggatgactgttctcagcctccaagcagcagaaagaacccccgaggaaagacgcacaagcgtgactttgtgagaatgaaactttctgtatatccaaaaaaaaaaaaaagggccacacagtgtggtcatgttttttaaagaactgacaccatttagagcaacacatgcagtgagcgttttgatgaaatgacgggtgctggcgttactcgcagaccatgactccagcatggtgaggctggtgtggggtgtgcaggacccatcacactaggctctccacttctgtgcttttgtaattttccataatggaagaagcagccacaaagaaaatgaaaagacaatcgacatgttgggatcaagtatttgtaacatacaacaacaaagtggcatcctcagcccattaggtgctctcataggctgctccagagccccacagtcctgcccctgccagtctaccactcctcgaagcacgcgccgctggcataatcagaacctcagtaggaaatagacaaaccagataccctccccaccaggcaggcgagtgaaagcagaggccagggaccaatctccccaggggccagggcggtgcccactgtcagagagccataatcagattcagcctggaaatttgatttccccagcagaggcaatgagccaggctggatgagacgccatcgggggttgggtagagggacagagatagctccccaggctgtccacatgctcactcagtggcacccgctgatcatgtgagggaccactcccatgtccagggagaatactcagaaagggcctcttcccacgctgctcctgccctgcactaatgcagtgcccaaggccaaaggtggccaagaccaaagctacactggccagccccagggggcatgctggatgggaggtccagggggactaggggctgtgtggggctgatacggaagctggggtccggtcaaggcagggtcactgctgggggccagggagctgggaagcctaaggttagggcaagggctggctctagtggccgaacgagcccagtgactgcaggcaggacgtgacaggtgagcaggcagggcaggcgagtgtcccagcaactgtccctcctctgtgggaggcatgagccacagggagccactgctggaggtccctaaagggtctgggcttaagattctcaatccagcaggtcacagacacctgctccctgtgccaacagcagcatcctttaagtctccttggtctcctgagacctgcctctccatgaggagacatgagatggggtggaaaggagtcctccaggtcccgattcaaaacagcccccaatgcccttcctgtgcctgacccagactctagctacagctgcagcagtgggtggtcctgcagactccaagccgtggagtagtggcagtgaggggccacattctctgggctccctgctgcatcctgcccagggcaccaccaagggctcaaaggctggggagctccagggagagggctgcagaggctgccagtgcagtgtcttctcccctgcacactcagcccacccactccgcccccaatgatgagcatgaagtttgtaggagtgtggagaggtgtagtgccctactaagtgggccggacattggtggcggtggctggcccattgcctccacggcttaccgggacgggcacccaccccgcaaggtgccgtgtggcccatgccctgccttagggagggcaggcgcagtggaggcggaggcggggtgtaaaaggcccagacatggagctgagccccgtcctctgtactctggggtgggcacagggaccaaagcatccctgaggagcgaactgacagggttcacagctaggctgggatcagaggcagacagccacagggcctgggagccctgccctaccatgccctacggccccactgaggcactgtaggagacagctgtccaccaggctgaggggcctcagcgggcaggtgcagcagtcaccacgctggccaccagcctgagtgcacagggccgtccgcctgcaacgccctttcccccctcattggaagacggggttagaccccttcttcccagcccctctatcaccatggaaacacccaggcttctcctgagggacagagcctctttgtggtgacacaaagcccctttgaggggaggtggggtgcagcccctgggagcctgtggccaaagggcccctggggggtaaagcagggcccgccggcccagcccccctcccaggtttcggagccaaggaagctgaggtaggagagccttcaggttaggccagcccgccccagctgcccacccagaagggtctccggatggatgagccggacagcccaggaggccaggctgaggctgggcagagacagcaccgagaagcctctctgcaggagctggggggttcctgctttcccctctgttgttttgacaaagaacacactctgcttagataagtggaaaacagcactggcaggggagctcccgccagtcaggaaatgcccaggatggctgcaggaacagtgcctggtgggagatggggacaggaagtcctccgtgggagggcaggcaggggccgtgagacggcaggtcagacagtgggaggtctggcaccaggtgtgccgagaggactggccctggcatctgggccccactcagtttactgtcctctcacttctcaagcctcagcctccgtcttcacctatccgcccagggggaaatgtcactggccttgctgcagccacaactctgggacaggccagagttggataaaacggaacctcaccatggcttggcttattccagggctggggaaatggaaccctgaggatgatgtgggtccctggcacagtgacagcatggctgtcccatccatgctacagccccacagccagggaggcagaggaggccaggccacatttccccagactcccagccctggagcccctcctgtactggcctgagagtccctgcccccacccactgactgctgctgaccaggcacctggcagctccctgcatgtgggcgccctgcctagaggccctcccgagttgacctcactctgacccacagcagctttgctaactaagcccctggggtggggttggggtggggatcactggccccctgcggcagcacgaggaggcactggcccagggagagatccatccttttgtaggcaaatctacctgactactagggagtggggccaagggctgcccccacagggcagtgcctgggtcagcaagcacttgctgcacccccaatggaggccctcaccacacccctcccaacctgccttccccactggcaccccactctctgctgacacctgcaggcacaggggtgggggttgggaccctccagctgccgtggcagggagtggccatagggtggttgctgtggtggacgtaggccatatggttcagaatggatcagaggatggtgtgggtgggagaattaagtctgggctgaccgcaagggatcaggcctgggtggctggagggaggggccgggaccctgagtgggagggtgcaaagggagtctctgaggctggagaggctgagggaccactagatgcatgaagttctggaagaaaggggttcaggctggagacagaaccaccggcaccttcagcctgtgaagccgagagataagacaggtgcaagccccactgcctcctccaaaggaccctcccctgaccttctagaacaaggggacaaagtcactttcccagccatcatcttccctgcactggaaggggcagaacgaggacccagcactgagaggtgagcctcaggaaggaggcagtgctgccagcccttggggacaacagcctgtcccctgaaagtcccaaaacccttgggaaaggtgctcctcactgtacccttctcccacccagcacatcagaggagccagtggtgtgagatcttgacccagcatgaagtagagcccaccctgtcatatgcagggaggttccatgtcccctttggtctgcccttgccccagggtcctgtgtggcctctggccagagctggctgctcccagggtgcctggggcaccgctcatcccttccagagcctgagctggatgctggccttgccgctcccaaccccctcctctgctgggagccagctccactccggagtgcccatggcaacaggcctagacaccaacctccagcaagtgcacaaagtcctgcctttcatatgcaagcaacacagagggccaggcagggggctgcaccaccccatccagggcagattccaggccctgcagcctcccatctggctcccaccgccacataccaggagagcctcgggacttgactgtgtgtccagtccccactacaaagaggtgggagaagtgctgacagtttggggccctcctcaaaggcacctactggcacatgtgtgcagccacccacactgctacggtgtgaatgctagtgttccccaaattcacattaaaacctaatctccaatgtgacagtattaagaggtagggcctttaggaggtgattagtgcccttatatgatcagtgtccttatcaaagcggctcttgagggctggtttaccccttccaccatgagaggacacacagcgccatctatcaatagccctcaccagacacggaatctgctggcgcctcgatcttggacttcccagcctccagcactgtgaacagtatgtttctgttgtttataaaggactccatctaaggtatttggtggcagagcgtgaatgaactaagacacacacagacacacacacaagcacacccaggcacagggacccacagctgccccacaggcacacgcaccagcaggcacactcgtccacacccatatggctgctgcttatcccacctagaagtcccgacaggccctttggggggtgggggacatcttggctcctggtgaagatcagcatgctaggcagactccattcctgtcttggacaccgggcaaggcagaccccctctgagacccctgaggccgggtcaagcctgcccctgacaccaagatctgcaggaccccctgcctctgatcccacatgaggttcctctgagacaggtgggagtggctgggcctgcagaccccgagcttgcacagacccacctgcagggacaagcacaacttacagcagcctagtgcccagggaagacccttccaccatgggaggactcaggaagccgcttcccgctgagtcacatttagcgcatttcttaggaaacagctggtatgtgccctagaaggttaaagacggtgttcaactccgctggccacagaccacaatgaaaaggagctgctggctgggcacgatggctcatacctataatcccagcactttggaaggccaaggtgggaggatcacctgaggttgggagttcgagacctgcctgaccaacatggagaaaccccatctctactaaagatacaaacaaaattagctgggtgtggtggtgcatgcctgtaatcccagctactcaggactgaggctgaggcaggaggcagaggttgtggtgagccaggatcacctcactgtactccagcctgggcaacaaaagcaaaacttcatctcaaaaaaagaaaagaaagaaagaaaaggagccgctataaataatgaggatcccatggagatttaaaggaaatcccagcagaggcagtaaacagcagactgtagaaaacacgcagtgtgaggctggagaaagtacactaagacggtcctcccaaccccaacagcaaacaggagagatgacaagaggatggtaggagccacagaagacagagcccagggccaaacttccacatgataggagtttccagagcgagaacgacagacagtgctcttccaaccacagaaaaacggccagaaaccacctcaacaggagtacgtccaacggggctatcagcgtcagggctggaatctgagttagggtgtgagccttctgtccagaaaagaagcccaggaagtcacggatgtgtctacctctggcttttacaattcagtctcatttcctctggctcctaaatgcgctgtgtccacttcgaggtgtagggaggagggtgcccagctctgacctgcgggctgtgctgaagcctgggcctctctctataccaggccgtctgcaggcctgcaggggctgcatactgtccctctgtaaatgtcagcctcaacacgctgctgcctgctgcctggctcccgtctctcacagctcagaagctgttttatgataaaaaagagctgacagctttgttaaaacaaacaaacgcctctcctctctacttgagatcttttacaaagttaacatcgctctgaaaccccataaggaaaaattatggtgaggtttctggattttcagaggcagcaaactcatcttacctagagccctggactacccagagaagtagttttaagaaccaaaagaagagaagaattcaggagtaaatgaggcctggataacccaagggatcctgtgcttgcactgctgggattcaaatttgggggctgccaccaccacaagtttgtgagaagcccacagcctgcgcatgaagattgtgtcaagggaatagcagctgctgatgtgtggaattgattttttcagcaagggcctgcgattctgaatgcattaaggcagctccagttgtctgtagcagtcctctgtcagctgcccattggaagcatttttactggctcaggaaattcatgggtttgtggactgatgactccaacagattaggtacaaatccaagaaccacaaaacaaaatctaaccaagccaaacaacaatcaaacaataaaacagaacaaaaaaaaacctcaatttgttttccttttctttgtataacattaaaataaaaagatggtaacagactaccataaagaattatacaccaacaaattagataacccagatgaaatggaaaaatttcctagaaacacacaacctaccaagactgaatcatgaagaaatagaaaacattgattagatttacaactagcaacaaaactgaatcagtaatcaaaaacctccagcaaagatggtttcactggtgtattctaccaaacattcaagtaattttaacaccaatcgtcctcaaacttttcccaaaaataaagaggaaggaacacttcctaattcattttatgaggtcagccttaccctaataccaaagccaggaaaagacactacaagaaaagaaaaccacaggccaataacccttatgaatactgaaacaaaaattctcaaaacaaacaaacaaacaaaaaaacactagcaaaccaaattcagctgcattttacaagaattataaacctaaccaagtgggattttactcctggaatgcaaggatggttccatgtacaaaaatcaatcaatgtaatacgccacagtaatagaataaaggacaaaaatcacaatcatgtcaaatgatgcaggaaaaacatttaacaaaattcaatagtctgtcatgataaaaacactcaaactaggaaaagaaggaaactttctcaacatgatgaaagctatatgtgaaaagcccataacatcatactcaatggtgaaagactgaaagcttttctcctaagatcataaacaagacaaagatggctgttttgaccacttccattcaacatagtactagaagttttagacagagtaattaggcaagaaaaagaaataaaagacatccaaattagaaagaaagaaaaaccatctctgttcatagacgacataaccttatataaaaccgtaaagattctacatgcattttttaaaaactctattagatgtaaaaaatgaaatcagcaaaggtgcaggataaaaaatgaatacccagaaatcagttgcatttctatatatgaacaatgaacaacctgaaagggaaatttaaaaaaactattccatttacaataccattaaaaagaatagaatacataatactaaacttaagaaacttaagatctgtacactgaaaactataaaacattaccaagaaaaatttaaaaagacctaaatcagtggaaagatatcccatgttcatggctgggaagatttaccactgtcacaatgacgatactactgaaagggatctacagattcagtgcaattcctattaaaatcccaatgacagccaggcatagtagcatgtatctgtaatcctagctagtcagaggctgaggctaaagaactgcttgaacccaggggttcaaggccgcagtaagctaggatcacaccattgcattccagcctagatgacagaacaagacctgtcaaaaaaaaaaaagaaaagaaaaaaaaaatcccaatgacattgtttgcagaaacagagaaatctatcataagatttatatcgatctttaaggagcccaaagagccaaaacaatctggaaaaagaacaacatttaaggactcacacttcctgatttcaaaacttactacaaagctacagtaatcaaaacagtgtggtattagcataaggacagacacaaagaccaatggaatagaatacagagcccagaaacaaaccctcatgaatacggtcaaatgaccttcaataaaggtgccaagaccattcattagggaaatgatggtattttcaacaaatgatggaactggatacacacacgtaaatgaatgaactcacacccttaccttattacatacacaaaaattaactcaaaatagatgaaagatctaaacataagacctcaaactataaaactcttagaagaaaatataggggaaagtcttcatgacactggatttggcaatgatatcttagataagataccaaaaacacaggcaacagaaggaaaaataaattgtactacatccaaatttaaaatgtatgttcatcaaaggacacaatcaatatagtgaaaaagcaaccaacagaatgggagaaaagatttgtaaatcatatatctgaaaaggaattcatatccagaatatgtaaagaactcccaaaacttaacaacagcaaaaaaacacaaataacccaatttaaaaatgagtggagttgaactgacatttctccaaagaagatatataaacggccaacaagcacgttaaaaaatttgctcaacatttctatcattagggaagagcaaatcaaggctgcaatgaaatatcaccttacacctattaggatggctagtctaaaaaaaaaaaaaaagttttggcagagatacagacaaattaagacccttgtgcactgctggtgggaatgtaagatcagtatggcaattcctcaaaaaattaaaaatagaattaccatatggtccagcaatcagaaaattctgcattatgtatctaaaagaattgaggccaggcgtggtggctcacgcctgtaatcccaacactttgggaggccgaggcgggtggatcacaaggtcaggagatcgagaccatcctggctagcacggtgaaaccccgtctctactaaaaacacaaaaaaattagccgggcgtggtgacaggcgcctgtagtcccagctacttgtgaacttgggaggcggagcttgcagtgagccaagatcgtgccactgcactccagcctgggcggcagagcgagactccgtctaaaaaaaaaaaaaaaaagaattgaaagcagagtctccaagagatatgtgcacaatcatattcacagcagcattattcacaatagccaaaaaggggaagcaacccaagtgtccaccagtggaaaaatggataaacaaaatgtggtatagatatacaatggaatatcaggcatcaaattctgacatatgatattctcatgatactaagtgaaataagccagtcacaaaaagacagatactgtgagattctatttatgtaaggcatctaaagtagtcaaacaataggaaaagtagaagcacttcaagaaaggggcaaacggggagttttctaatgggtacagagtttctattttgcaagaataaaaaaaagttctgaaattggttgcacagcaatgtgaacaaacaacactactgaattgtacacttgaaaatggttaagatagtaaattttgttatgtgtattctaccataattaaaaattaaaattaaaaaagaggctccctggccaggcgtggtggctcacgcctgtaatctcagcactttgggaggccaaggcgggcggatcacgaggtcaggagatcgagaccatcctggctaacatggtgaaaccccgtctctactaaaagtacaaaaaaaattagccgggtgtggcggtgagcgcctgtagttccagctacttgggaggctgaggcaggagaatggtgtgaacccaggaggcggagcttgcagtgagccgagatcgcgccactgcactccagcctgggcggtagagcgtgactctgtctcaaaaaaaaaaaagaggctccctcacataataagtaagaaattgcataatacccttttatttatttattttttgagacggagtcttgccctgtcgccaggctagagtgcagtggcgcgatctcggctcactgcaacttccgcctcctgggttcaagtgattctcctgcctcagcctcccgagtagctgggactacaggcgcgtgccaccatgcctagctaatttttgtatttttagtagagacggggtttcaccatgttgaccaggatggtcttgatctcttgacctcgtgatctgcctgcctcagcctcccaaagtgctgggattacaagcatgagccaccgcgcctggcctacccttttgaaataaatagtatatcaaaggtaaaaatttaaggctgggtgcagtggctcacacctgtaatcccagcactttgggaggccaaggcaagtggattgctggggcccagaagttcgagaccaacctgggcaacatggcacaaccctgtctgtacaaaaaatacaaaaattagccaggcatggccgggagcggtggctcacacctgtaatcccagcactttgggaggccgaggcgggaggatcacctgaggtcaggagttcgacaccagcctggacatggtgaaatcccatctctattaaaaaaaaaaatttaaaaattagctggtgatggtggcaggcacctgtaatcccagctactcgggaggttgaggcaggagaattgcttgaacgtgggaggtgaaggttgcagtgagccaagaatgcgccactgcaccccagtctgggtgacagagcgagactccgtctcaaaacaaacaaacaaaaaggaaacagttcagatgcagctgtaaaaacaaagttaaatccttgccgtccatttacatcagaataaatactagtttgtgctatgggctgaacgtgtcccccaaagttcacgtgttggaaacttaattcccaacgcaacagtgttgaaggtaggacctctaagaggtgtttaggtcacaagggctctgctacatgaatggattaattccgttacagtgggagtggatttgttatctcgggagcaggttactgataaaaggatgggttccgcctccttcagcgctctctcacgtgtgctcctgcccttctgccacctcctgggggatgtagcgacaaagaaggccctcgccagatgtggcccctcaatcctggacttccccatctccaaaattgttagaaataagtctttgtttttcaggaattagccagtctcaggtattctgatacagcagcccaaaatggactaagacagacagattaaatgctgtgtacaaaactaaagtaaaaataccttctagaagaaaagacaggtgcatctttatctggctgcatgctagggagagttgactacacagagagacggaatatctaaaaatggggaaaaatccaacacacttcaccacaaaatatgaaacatttttgacatcaaaatgatcataaacaaaaactaaaagggtgagaaaaatgtgcagtaggcagaaagaggagtgaagaattaatatctttaatatacaaagactcatacaatggctgagaaacacatcaaaacccaagagaaggcctgtcataggggccaggcggccgcaggagacgaagccgcaaccccctgcaggcacacggcggctgatggaggaggccaggctggtgctggtctctgagaggacaccactgctggccagctatgggaaacggcagggcatctgtgtccccgccagcccttctcactcaggcctggtctcagcacgcaccaccccatcacaccctcccagctccccctcctaagggagccatgctactcatcaccatcttgtaaccccacagttggccactggttcctctgtgtgttgtggatctcctcaaccaggctgggagctcctcaggggcagggctgggcctgatgtgcctgtgatgcccaggacccagcatgaggctgggtgagtgggtgctgagtgtggtgacacatgggtgtttacatcagcccctgtcccagctgagccctgaggctccctccccagctgcctcccgctgtggacaggaccacaccccagggcccagcagagcaggcagccgcaagccagagcccaggttgcccaagccagagcagagatggcacaaatgccatcacccatcgcaccagtgcccagggcagacatgaaaaaccaatcaccacagcagacaggaataagcaatcaccacattccagatgggcaggataggagatggggaaaggcagagaaagaggcacagagagggccacagagaaacatagagaagaccaagaactggaggggggagggaaaagaagggacaagaaaggagcaagcaacaggagggagagtgagcaagtgtgcctgggcagcctcggacctgcccagccaaccaccctcctgcggaccctgttaccagggctgtcgtttggtgtctggctgacctggcctccctgaagtgtggtgacctacgaggagttaagggcagtgggacagcccctcctgccaccctgagatgccctgtcacctgtgccacaagcaagccaagtaccctgcctgagcttctttgtcccaacccagaagaccctgcatggccaaatggcctgagcagtgacattctcggccagacgctggtcctcccacacagccaggcggcagcagacccagctcccactaggctggcccggccggcagctttccatgcccaaggacttgggaacaggcaaggagtcagtcatcctgtccctcccatctgccctagatccctcagcctaggtcactcaggcatccggaggccatggccttctccctaccacttaggcacagcactggctgggccatgcctccacaatgggcactaattgtcactgagaaaccacagggctgtcagccatgcctcccacagagactgctttttggggggacaggcagatggccagggtggggactggaggaacaagaatggccaggagccattctcttaagccatcacccactctgctgaacagcacccatcgtggcaaaactctggcagcgtggatgtgagcagggtatgccttaccatccttcagagggtcctgggggacatggaccactcagcctccaaccctgccatgcttcccaggcgctatgcctcagtcccactggagctagcagccatgataagcagaggaaccccaaacacagataacacctgaggccacgggccagtacacatggcctacggctgtgatcagagtacattcagactattcagttatgggctgtctgcagccattttcatcctacaatggcagagaactgcagctgtgacagagaccataaggcctgcaaaattgaattacttactatcagaccttttcaaacaaagttttgtgtgcctggcctccaggactatcctctgtccctgtggctccagtctctggggggcaagcgaatggcctggcccagcaggctgtgccaatactggatgccactgcggctggcatcctagctcaggcaggtgaagagcagacccagtgaatgtccaaaccaacactgaccagcaacctcgtcagccagccccaaacaggcttgtccctaaagccagacatcaaaccagtggctgctgcccatattcaggccagtaacaaacccaagctggtggcaggaggccctcacatccaccctgtccagcccaggggctgtgcctacccagggtgagaaggaccaggagcacacagtgtccagggccagtccatccctgtcacccccacccgccaggcccaccagaacactctgctgtcctatgtgggagaggatgtccccaagctaaacccaggccactcacctgtcttgagggaagatcagcatgtcccgacacccaccctgcaggctctggctcctgcagggaaaccagagggcatgagtgaggtcaatccagctgggtaggtccctgccggataaaggtacacaagcccagaccgtcctctaagcaggaccttgtcatgcctgatctgaaggtcatcccgtggtgctcctgactcataaccacacactcatgtgtaccttcttgcccccacatgtccaggactgtaggtgacactgggctgccacggttccttgtcagcatgtctaatgctgttgaccatccttcagaaacgtgatccttcagagatgtggactgataatgacgtcttccccatcacacacagcacagcagtattcccaccccagggtagccaggctcagggtcctgttgccccacgcaggtgctcacagccccataagacatctgctccacctccctagagtccgctcccgccttgtgggcgaggccacgtgcctctcctgaggttccctgaggccaacatagatcctgggccctcccaggcaggcagctgcccccaacagtctccagtacagggagggcggggaagcaggcaggttcctggccctggagctgtggccaggtgtgaataaccatttgtctgggatgggggacctggcactcaagcctggggagctgaggcttatgggctggagcaggagacaagggggtgcctgtactcacacagctttcagccttcctcaggggaggaccctgcggcttcctgtctcagctaatggccccggggacacattccctctccttatatctaggcccggggatattgccagagtgttcatgtcataaaaatgaaaaacaggacactgcagacagacagggaagggctgggcctcggatgggaggctgtctctgggggacatcggtaatgagagctctctcccccgcctctacggtgttttctagattgttctgaggccccgcccaatagtcctttgtggtcatggtccattctggtgccccaacggtgtgtttccccgtctcacgacagcctcttcatcatgggaaggggtccaagtgagggtgggcgactggctacgcctcagggtgggatcatggggggtgggatgcagggcctgaggcagggaagaactggggaccaagccaggcacatgtgcatatgcatgtgcgtgcatgtgaatatgagtgtgtgtgtgcacctgagatgggcaggcccggttgggagcccatccaccagcactgcgccccgaggaagaggagatgctgctcctactccaaggtctgaggcttaggaaccagcttttgctctgagtgtgacatttctaggaaacctctggttttagcttaagtgttcacataggttttgtaccacagagaaccatgtgactttttttttttatccctgataagcaccagcctctcccccggagtcaccatgtgccacagaaccgagacacactggctgtgagccgtcatctcactgactctaccaggtgtctcaggttggctatataccccattttacacatggagaaactgggtcccagccagacaagggctgggccaggatttaactcaggtcttcctgcctccaggcctcccaaagtcccccccccccacccagttggggaagtgtgaccaaaggagaacatgggtccttcctcatgggcctcctacctcatggggtccagccaggccaagaacctgcaaccatatggtagagccaatagcagaccctgggaaggggtccaagtgaggcattggagagggcttcccccaggagatgggtgggagcagaggatagcagcaccacaggaggctgagtggtaggagcagccagagctgtgggtatccttcctaagggtgcactaggcacatcagcatcgtacaggcaggggcagagcagagcatctgtggacaacctaagggagctctgggcagtggacggacagagggacgacagacaggacagtgatgtgaaggcagaactagtgataggatcatatgggaaggtggggaggtgctcaccttggggagcccccctgagtgctctgcaagctctggggtcacctgcctggccaaggacccagtaccagccgcctcaaagcgggggaatgaccacgccctttattgggcccttttcccagtgaggatggcctgggcctacccatgccatgggacccccacactgggtctccccaccaaactgtccagacccgatggctggccatggggctctgtcagcccctggctacaccccactgatgccctagtaagccctgtggttctggcacggtatccatggtccaaccagagggctgagaggtctcacactggggcataagcctggcccaggccacacagccagattggcaagctacagtcctttggatagctgacggcacagggcagctcccatgggtacacactgggcccagaactgggatggaggatgcagcctgggctgggtaggcaatgaggggcccaggtgagctcgctctgcactccctgcagtgtggcctcagcaggccaccccctccccaagtctcctcgcttcctgctctatgagcgcgaggtgacactgactgtaggtagctgagaacatgccctggcaacagccaatgcaggcaggtgaatggagtgccccgtggccagtggacagggaaggtccatgctgctcaatgacaatgctgtccactacagcaaaaccgagtgttctcctaggcctgctgccaccctgggcacatagtgagaacacgcccacttctgctgtggacattgaggcacagaccacacctgggaaggcttgggaggcccctgggcacacacttgaaggacactgcacttttggggctacgcaggcacagggctagtccttcactgtccctgctgagcctgtgtgtggtcacccaccagctggccttcaggcttccttctgcctgcaccaagcatgttgggggtaccgaggggccttgcttggctcctttccaactccacgccctcaataggcggcttggaggccgagctccggtcatccaagccaggtgtctggggaagggtcctggtctgccgcaggaagctgggtggagccggtcttgcctgctgtggcggtcccagctgccctctggtggccatgctcagctccccgttgctctgccagaggcggcagcccctcaatcagcaggggcagtgggaagggcctgtgcataactggttatggagtggggggaactctgtggccccaggcacccaccagctctgggtcatcttcccgacctgaaacaggccaagatatgaaggccctgagccaggaaaacctactaagggatccctgatcccaagtcccctcagagtgacccaagacttcatcttgggtttttctgtttgtttttttgtgggtatttttttttctttttttgagacggagtctcaccctgtcacccaggctggagtgcgatggcacaatcttggctcactgcaacctctgcctcccaggttcaggcaaccctcctgcctcagtctccccagcagctgggattacaggcatatgccaccaggtccagctaatttgttttgtatttttagtagaaacagggtttcaccatgttggccaggctggtctcaaactcctgacctcaggtgatctgtctgcctgcctcggcctcccaaagtgctgggattacaggtacgagccaccgtgaccagcccatcctggttgttttgtttgtttttgttttttggagatagagtctcgctctatcacccaggctggagtgcagtggtgtgatcttggctcactgcaaccctcacctccccggttcaagcgattctcctgcctcagcctcttgagtagctgggactacaggcgcatgccaccatgcccgactaatttttgtatttttagtagagacagggtttcaccatgttggccaggctagtgtcaaactcctgacctcaggtgatccacctgccttggcctcccaaagtgttgggattacaggcatgagccactgcgcccggcctcattctggtcttaattgaagctgctgacaaaagaacagacacctccccatgactaagccaccatcagggaagtccccaggacccccaaggcccagctggtgctctgcagtgctgtccctggacccccaccctccattcctggccctgtctacagaatgggccctgactccctatcccagctctaccctgtcactccctctgccagggccaggcggggagcacgacagatgggctggacagagggtggtgcctggcatccgtgtgcagagctccctgctccacccagagaccggggatcctgctgctcctgcaccttctgtccttactcaggacagcctcatgctcccccaggccagactcctggggtgaaggagcacagggaactcaccctgaatccctgtgtagcacaaacagaaggaggggtgctaccctaccctcacagagccacagagatgcagagggccccgggactggggggagactacagggccacctctggagggagtgccagagcaaacatgggagccaagcagcccagatgtggtgggtggggagactcaaatttagcaggattgagggtcagaacttgttctcccaggaggaaccttggtcagaaggtccttgtgtttatgctgaaaagcctgacagggcagctcagccaagagctgggcaggggctggcttggctgtgctcaactaccctctcagctgggacttgagtcccttagcgaatgttctgtgcccagtcctctgctgggcgctggtggaccccagaatgggggtagggtggggacaggggacagctgggagcagacattgcggataggatggggcaagactgggggaaatgccttcccagacacgctgcggctcacactgtcgcctgatctaaggcctggatcacctgcttaggagctgaccggccactggcatggcacaccgggcaagagagcgctgactgcccccctgcattcagcaccatcccagctccaatagagtgagtacaagataggtaacacctgccttgtttggaccagacctctaaacaccgcccagatcccagagtaaaggcagataaggcagtagttaagaagtaggaagaagtaaaggcagctaccccagagaagctaaggtcgggagaggtggaggctcccactgcacccccctggcccataccataggggaggtttcccccacagcagcctgggtactcacctgaggttattagacagcagcattaagagcctactctaaaaaatacccacggggcacctttcttttccttatttctaaatatgcctggatgtagggaaagggagctgaagtcctttagttccattttaagtatgttacattacacatagctaagaaacggtgaaatattgtaagcagccaatatttaattatttaaaaattaaaataggctggagctctcaggccacctgcccagggcgactccccagcaaaccgagcagtctccctcagagtggagatgacatgtctccgcaccggcaccgagggggcgcagggcggcgtggggagggggacccaggccgggggtccgggtggcgcgccctctctcacccccgaggcggcaggagcagcgcggcgcgaggacacctccgggccgtcggtgcccctgagcttcccggcggcgcgctgccccaggaaagttcccggcctgccgcccctcgggctgttggaaagtttcggcggctgcagggccctggcagctaggcgccaagcgtcgcgcggggcgggcacggctgcggggtcgggccgcgctcggctggagtgctcagtgcaagacgcccggacgggtagggtagggccccaaggccacgcacaaagagacccgcccccgccggcccggggtctcggacgccgcagagcgcgcggacaagacgcgggtggggcggagattggctccgacgtccggcccagaccctcgcccggatctcgactccagggataggaccctgtccggaccgctgcccggaatgcgtcccatatctgcagccccgcccccagtcccggctccgacccgaggccccagccccgggtcccacaccccgcccactggctcaggcttacctggagcgcagcgtgggcggccccgcagcgcggcctcggaccccagaagggcttccccgggtccgttggcgcgcggggagcggcgttcccagggcgcggcgcggtgcggcgcggcgcgggtcgcagtccacgcggccgcaactcggaccggtgcgggggccgccccctccctccaggcccagcgcgcaacccgagaccccgggccagccctcccgccctcacgcggcccgtgcgcaaagcggaccgggccggcgacgcgaatctccgccccgccccatctgacagcaaattttcccattggtcgagagacccggcgcggcacggcaaccggcgccgattgggcggatgcgcggagatgacggcttgccattgggcctccgggatgtcagtcccggcggatgaccggccccctcgcggaggggccgcggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacaggtatccttcttcagcgcctgctactcgctgcgcgctgcgcgccgctccctcctgtcgacatcgaattgtattcttcacgcaagccgcgagagagagttctgctgctatccccattttacagttgggaaacagcctcagagaggttctcacttgcttgaacacagtcgtctgaccctggggcctgggggctctctcatcctcacgcccctgggtccccgcagcggggagacgatggaggtaggagctgcagtatttccgagggcaggaagggaccccctcggtaaaccaggggctcacctcccccaccaggcctggatgtagagacctcttgggcttgtcccaccctgcaggccccccatggggccgccctttcttacctcctcctggcattctcacagccccacagctctgcgtctggggaggcagagttgtgcgtttatgcccgcaccccgtactactgtcccattttcttcaccctacctggagtcaggaagaaacggtgcttcactgcctgttgagattcacgtaggttacatttccttgccagattaagagcacctgacatgagtgggaccatgaccctccgccagctctgcgtaaccttgtggtgtaggggggaaccagcagggatgctgcccagtgggcttttctagggggaggtcctgagatgacttcttagccagtgaccctggctcacgcatgctgtcatcctttcctgccctggatgcacctggagatgaccagttcctcggctcattgcattctccaaggccgcctggggaaccaaactgcccacaaccatgcttatgagtggtggaggggtgtgaccagacactcttgtcttatccacccatattgggagtccagtgtgttcatccaatcattccttggccaggacaaagaaaatgaaatggcccaaggcaagaactcactgctgggaccaccgctgggtccatctgtgtgctggcagcatggtgaatcgatcccagctgcctttcagagccaggcagctactatcaatcgattggagctggcacttgacgtgccaattggcctcctggcatagggttgttgcttgctgctctgggagggcagaatgaagtagctgtccctagaataggggccctcacaaaccaggtagctgtcatcctgtggagcagcaccatggtgacattctggctcaggtgctgtgtagctgaggggtcgtttcctccatttaggagtagacgtaatgagtccagctgtccccagccatctcttcaaggccattggaccctggttctgctggagcccctcttctcacagttacctcatagtcctgcaccaccccctccccacacttgcaagagggactggacagacctctgttgaaagagtgcaaaagacagaaccatacaccaaaatctgtgcaagtgagactacctctcctctcatcaccacccctaccacccatagggttgcagagacctgtctgccctcggcaggcaggatcattagctgaggtcagaggatgtcggggcagcaccaattcaaacaggactcaggaccgctgtccagcagtcggcccattaggctgcagccaggggtcagaaacacaacaagggaggctgggcgcagtggctcatgcctgtaatcccagcactttgggaggccaaggcaggcaaatcaccagaggtcaggagttcgagaccagcctggccaacatagcaaaaccccatctctactaaaagaatacaaaaaaaagtagcggggcatggtggtagacgcccatagtcccagctacttgggaggctgaggcaggagatcgcttgaacctgggaggcggaggttgcagtgagctgaaattgcaccaccgcacggcagcctaggagacagagcgagactccatctcaaaaaaaaggaaaaaagaaaaagataagaaaaacacagcaagggagaccacagggaccagtagcccagtgttctccctctctcatcctctcacctagctccatgcggacagctgtgaggcccccggagaaagccacagagagaaaatgctttcagctgggtgtcaagaacttttcaagagtggcagctgttgaaatcaaaagagtggccacagaaggtagtgagcttcctatctgagtttgtgtgcaattagaggttggatgccagtgagcctgttgcagccccaagatcccagggcttaggtgcccatcctagacccatttcatctgccgtcacctgcttcctggcatcgcatgtcatccagactggagtgtcagtggtgacaaagaagatcagagtgtctgctctggctctgtctagctgggaaaagtatggctgggggtggggatggcccaaggccacaaggtatgacagaacaggatgcaaaccaccatctgacatgttactgcatccctctttgtgggcaaagggaaaccttggtcaactcatgtccagctttgaggtgcatggcctggtgctttggggaagcccattctccaggtgctgccatgaaccccagggcacagtccatcacccccaagccccagatcccacttgtccaccaccaccacctcttggccctatagattgcataggtttggctgctcagagggaaatcactggtaccagccccacatgatcccactgctggatggtgggagagacaaccatgtctggctgggtctgcggcccgctggccatgagtccctgggcatctggagtccttgtaaaaggttctgttgggttccaggggaaacacagataagatagcaaaagtgtggagcacaacgggcccgcatgtaggtccaggttagactcttgccgttgctgattaccagccaggctcttcccatccctgagccccagttttctgcagggcatcagggcacctaggtcttcaacacaggttgaagctaatgtggcctctcttgcttgccacctttttcaacttcaactgaatgacataactgctccaagtctcagtgtttacatctataaagtgggatgaaagaactgctgacccagacattgggtttagagtgctttacacattatcattatccctaatgtctttgtcatccatgtcatagttttttgaatgctcactttgaggcagggcctgagcctctgggctttgactctccacctttctgccacataggcccaggcacagcccagaggctacaggagcagcggtcccagctaatgcctctgtcctgttgggagggccccagtcagtgcccacctgctcaccctgcacaagtcaagctgggccagcccctcgtcgctggggcctggacctggatgtgagctcaaaggctacactggggggtggaagtgggggaggtggtgggtgtgcagggtatagtgctcaaatgcctagtccagggtctgggggtacatactgggaatggcagggacatcagggaggaaagagccgacctggaggccataaagtgaaggaagggatgaccaagaggaagatggccaggtccagaggtggggttgagtgaacaggatggggagaccaggacgcagtctgagggggccagtccggaagtgagcattcctgtacctcttccgagagaggccgcagggtgagcaggtgacagatggtgtccatgagggcatggactcaggggcggctgcgacctcccatggcgtccctgcaggcagggagccgcggagtccccgaaggccgctggatcaggaagcgctcagacgcccgcgcagcccgaagctttggcgcagccccgggggcggggcgccaggaggtggcagcctccgagcgacagcgcgcccagccaacgggacgccggcatgcggcgcgccgccccgcccctcgctgcgcggcccaatggtgaacgcgccggcttcgggctgggcggtactgggctggctgcggtggcgcgcgggcgcggcacccggaagtcggcggcggtggcggaggcggtgagtgcgcggctccggggctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgaggtatggtatagaatcaggcggctgggtcaggggcaaccacgtcgatcccggccgacgaaaatgccccgcgcgttactggaaggtgtttttgataatccccgctggcacgggatgcgagggactctggcaggtgggaccagactcgctgcggggaggctgagatcggcagggttgggagctgcgtggtccctgcagggtgtgtgggctgctcggccttggccagcatcagggacagctctggcgcccggtcactctgccccctacccgcggcctgctgcgggccagcagggtgacagctaatgtgggtgtgagtagatagtaagtgctgggtcatccctgcgcctggatgcggccttcctggggaggtttgggtagttagatcccccacccccaactccagagcgtcagaggtaggggctggcagggctgcactcagggcagtccttgccccaccgctgggctttgtagcagcctgggctttgcccgttttcctctaggaagtgggcacagagggctgtttgctgagacccccaccttccctgcccctagcacctctcctgtgctcccttggcttcctgctggaccacaagctttagagtgaaccgtctgcccttggacaagtccctgggcctcaggcccccttcctcttcaggaatgtcacatgccctgccctggccaggcctgtttgcactgtcgtgtggctctagacctgctgaccactgttttgctgccactctgggcacagtgccctcttccatgaggcagatgtgacggcagctataagggggtagctgagtagctctttggaaggctttctcacgctagctcatttgcctctgggcagccttttggggcaagcattcattgatccagtcctgctcatacaaggaaaactcaggctaaggtggcagatcgtgttcccaaggtcattcagagccagggcctgctcccagtgcctctactactcctgggccactctcttaggagtgtccctgtgtctgtgtcctgcgtctgtgttgggtgggctgggagcagctggagagggtgaccatgttgttagatggacacagcagagcctctgttcccacaggatcctagtgctctggtggtccagggtagggtgccctggtgcccccaccccctttgacccctacacagctttgtgttacttgcatgtcctcagactgcaggcccctcagaccaagcccctgcctgctgtgatgtgtggtggccatagcccttccctgagctaaggtgaccagctgtcagctcttcctgggctgcccagcctcttgtgcttccttggtcttcacttgtgggctgtcattctgattacgttttgcagtgtgtggaatcacgtgcagtgtcctgggaacttgatcctgtgcccggcttctgcgccagacggcgaacttggagggcaccccggtgcccacccaagggtgctgcttctgaaaacacccacagggatatgaggggcttctcagggaccccagaaggggtctggagagaaatggcccgggatagggaggctgggaagacttctcgaagtagggccatgcttgtcattgacactccagatgcatgagaagcagggcccatcctttggtgacgtgtcagtcagcacatggcagcagcatggcagagcctggcctttgttggcccctaccatagggcttgggctgtcttgaaaacaagcctatccctaccatgaggatgggctccgtgaaaacaaggtcaccccagaaagactgagctgctttttgaggttatcacagctttttcccctttttctctcaacttcccttttagactgcaaaaatagtttatgcatgcttaaagataaaaaaggctggcctccttctcccagcggctgctcccctggtgcacttgctgacatttgggggtacatccattgagatcttcagtgccatgctaacttgaaacttgaagtgcttgccttcatcctctttgcgggcatggtaggagtgcccccctttttttttgtttttactaaccactcaggccgcaggggccgctgcgaggctggcctgtccctggcttgtgaggaagctgagtgttcctcccaggagggcctgaggatggggccaccctgtgtccagagcttgctgtctgctcacgatgcctcttgtttgtgctattccttggaactgggaagagacagtgatcctctggtgtgaggctgaagaaatgccccggaagcattgtgaagatctgaggagagagtaccactgtagaaaatgtgtcatgataggccaagcacggtggctcacgcctgtaatcccagcagtttgggaggccgaggcgggtggatcacgaggccaggagatcgagaccatcctggctaacacggtgaaaccccgtctctactaaaaatacaaaaaaattagccggacgtggtggtggcaggcacctgtagtcccagctactcgggaggctgaggcaggagaatggcgtgaacccaggaggcagagcttgcagtgagccgggatcgtgccactgcactccagcctgggcaacagagcgaaactccatctcaaaaaaaaaaaaagaaaatgtgtcataataaaatgccatttaggcccggcacggtggctcacacctataatcccagcactttgggaggccgagacaggtggatcacctgaggtcaggagttcgagatcagcctggccaacatagtgaaaccccgtccctactaaaaacaaaatacaaaaatttgctgggcatggtggcaggtgcctgtaatcccaactactcgaaaggctgaggcaggagaattgcttgaacccaggaggcgaacgttgcagtgagagaggtcaccctctccagctgcccccagcccacccaacaggaccattgcactccagcctgggcgacaagagcaaaactccatctaaaaataaaaataaaaaatgccatttaatagccagagagtgtaaactggtgagctcttgctgcggagataggagggagcagggcattgcagtggactggagactcagagggtttcctgacgtcaggactttcttcgcccaggccccgtgaacagcgacactgtgttcccacgtgtgtttacctcctctgctgacagccaccgggagcccgcgtcacatgtctgtgtctgcctttgaaaagagcaactcgtgctttcaagctctgcccctgggggctgccaccgctgatggagtggggattacaagggatggggattgggcgcccggctgctcagccctgcagcaccagcccttgtggccattgaggccattaaatgggggcagcagactgtagggcttagtcaccctctgttcagggactcaccatgtgcagccccaataggagcccgacttgatggctaccctcccaagtgtctaggtccccttgaccctgtggtactaatagcttgccattcctctgtcaccactgctttctgcttagcacacatcccctctgcccatgtgctatgcttgccttttcgcttgccaaagggaagtggttccgccaaaagcgtgtgtcccatcccctctggcccccagggtctccaggtgtggtgttgctgcgacagcccagctacaccccgtcctatgcagagctgtcttgcaccagggctgattgggtcttctcttgctttctgtgaacaagtgactcttgggttcttgcccttccttccctctcttccctgcccatagaaatgtcccagccctggcagggaaggagggcaggatctgtacattttctttttttttgcgttttgagacagagtcttgctttgtcacctcaaaaggctgaggcaggagaatcgcttgaataccggaggcagaggttgcagtgacctgagatcgtgccactgcaacctctgcctctcaggttcaatgcgattctcctgcctcagcctcctgagtagctgggattacaggcgtgcatcaccacgccctgctaatttttgtgtttttagtagagacggggtttcaccattttagccaggctggtcttgaactcctgacctcaggtgatccacccacctcggcctcccaaagtgttgggattacaggtgtgagccactgtgcctggccagtgcactttcttttgagggtagacattactgttccccgccgggaagcatgcttactgggtgtgcacgctttcagtgtctggcgtgacagattgtacaaagtgaacccagccacacagctaccgtccatatcacaccaccaccagcacccagatatctccctcgtgtcccccagtggctgcctagaccaggtggccctgccctgcctcctgtccccatgggcagatgttgcttatctctggcctctgcatgaaagaccaagcagagtgctatcttctggctgagacctccctgctgcctcatcaccatggaaaggcacaggctggcttcttttccaggttatggactttcttactgtgtcactttgtggacttgggcacctgcagagtgcctggcatggtgagcaggagttggggcatggcgtgatctaggcagggtttggaaggttctttgaatagccaagggggacagtctggagggtgccctccagacacctgagaatgcattgaagctagggtgactactgcagcatcagaggcctggtgacacatttaaggcctcaaggggcccatgtgactagaagtccaggatgtggctgaggtgggccagactggatggccagcggccacctaaggacaattggctgtgcgtttgggaagcatgggtggtccccacctcacagcagtcgcacaggcagacagtgggcagatccaagagcttcaccaaggctgggcggggtggctcacgcctataatcccagcattttgggaggctgaggcggggggatcatgaggtcaggagttcaagaccagcctgaccaacatggtgaaaacctgtctttactaaaaatacaaaaattagccaggcatggtggcacgcacctgtaatgacagttacttgggaggctgaggcaggagaattgcttgaacccagcaggtggaggttgtagtgagctgagatcgcgccgttgaactccagcctgggcgacatagcgagacttcgtctcaaaaaaaaaaaaaaagagcttcaccactgtgcaaccatacaaggtagataagaaaaaggagttctcattttgggacagggagggcctttagcaggacgggacatgactgctgtacagtaatgatgggaaaatcccatgtaatataaggctatttctactagacagcatcacaggcagagctgaaaggcaggggatggctagggagaaaacagttgcaggcctgggacaggcacatggttgcccacatcacaccagctgcactacgggtcagtgagacaaaggcctagcagtcagtacccatgttggtgaattgttggcaagaacatacaggaggtcacaagttgcccagccagtgggggatgcccataaaaccctggcgggaacatttcccacactgcatacaccctggaggcaggtgagtggcaacaggttctggtgctagacgttagcggggacttggccaagtctgtttatctgaaagcgtcacccatggatggagcaattccacctcttgcgtctatcctaggaatgtcctcagctgctctcccactgttgtaaagaaatacctgggactgggtcatttattaaaaaaagaggtttaattggctctcggttctgcaaggtgcacaggaagcatgatcctggcatttgctcagcttctggggaggcctcaggaaacttacaatcatggcagaaggaaaagcaggagccagcacttcacacggctggagcaggaggaagagagagatgggggaggtgccacacacttaaaaccagatctcgtgagaactctatcactgtacagcaccgggggggatggtgttaaactttcatgagaattctgcccccatgatccaatcgcctcccaccaggtcctgcctccaacactgggaattaaattcaacgtgagatttggtggggacacagatccaagccaaatcagcccatgtgcagagcatgtgctagggatggtcgcttgatgggacgaagacaccagccacagctgagaggcagagcagcgggaaagctgggcagtggtgaaccagtggggacatggctctggtggagacagacctcatggccaatcagggagaacggagcaatgggaccctagcgtgttaaccccacagcatacatgtgtctgctcacatgtgtgtgcaagcaggttaagaacactctggcgccacaggcagcccttggctgaggctttttttccttttttttttgagactcagagtcttgccttgtcacccaggctggagtgcagtggtgctatcatagctcactgcagcctcaaactcctgggctcgagcaatccttctgcctcagcctcctgagtagctgggactacagatgcatgtcaccatgctcggctaattttattttattattatttattttattttactttacttttttgaaacggagtctcgcgctgtcacccaggctggagtgaagtggcacaatctcggttcacggcgccctccggctcctgggttcaagtgatcctcctgcctcagcctcctgagtagctgggattacaggcctgcactaccatgcctggctaatttttgtatttttagtagagaccgggtttcaccgtgttggccaggctggtcttgaattcctgacctcaaatgatctgcccgcctcagcctcccaaagtgcagggattacagccatgagccactgcaccctaccttattttattatattattagtattatattgagacagagtctccctctgttgctgtgttgcggaagtgcagtgacatgatcataattcactgcagccttgatcttctaggctcaagccatcctcctacctcagcctcccaagtagttgggaccacaggcatatgccactgcacctggctaattgtttttatttgctttttgtagacagggacttgctgtgtttcacaggctggacttaaactcctggcctcaaacaatcctcctgctttagcctcccaaagtgctgggatgacagacatgagccctgaagggatggggctttggcccgttaaatgtcactggaaatgtttccctccagaatgtgctcctgggtgacctgagcgatggtattaacaactatgggtcccaccagcctccagagctgccagtcgtggctacaggagactcagccttaggctggggcacagagaggctgaatagagggtgaatgaacaggcagcgtatgggagggaccagcgtttcttggtattatacaaaagctagtggaggtggtgctggttggtgtggggtgggcgactggcacggtcagatgcctgatgcctgttggcctcctcagaaggggaggctggcagtagtgggttctgggacatgcaggagggtggcctggatttgccctgcagcactgaggtctgcctgttccccactgggtcctccatttgaggccctgtcagcatggccctcgtcccccttgcttcttttccccatgggcctctgcaaggttactgcccaccctccaccccacctacctgcctgtggtgggcactgagagccagggaagcagatcctcactgccaggcagcaggccatgtgcgcatccatcagggtgccagaccttgtccccacgcagccctggctggggtcactgctgctgctgctctctgcctgtggctctggcccatctttgcccaggcgttctgtctgaatggttttcttgtcgtgccttttttagacaccgcatggagtgaggtttggggcttgcctcaactggagtctcattcttcttagagagggagtttagcccgtttccatttggccttaggacagaaggccctgttggtttctctgagaagccaggggaggagccctaggctggagaggggattctagagcggggtggctctcagaagcagaaggtgggcagagaggacggtgcacgctgggagagttctcgaaagcatcagcagatgggcccagagtgcctggaaagcttccgtccttcacagacagcgccatgctctaagaataacccatgccaagtccaggctttcttcctgttttgcagaattaccaggttgttaggctaggggaacgtatgctgggattctgggaagaattccacccgcactggtattcttagaggacgggaagcccttggctgcggtgtgaagagggctctctctttccattcatatctcatagatcctctggccaggcttgggggtgttgagggactccaggagtgtggggggaacttcctccctggaagaggcctgtgctctgtccctgctgaggctggtggcatttgcagtcacatggtgagctcacagtgactgtccccctcttacctccctggcagggttggcaaagaccacaccaaagtcccaagtgattagttccccggcctccctgcacagaggctgtgcatgtcccctgggcattcactctagctgtctgggctgcagggaggcagggtgcctggcccaactggagatggcactctactgggggtggttaagtgttgaccatcacaaaggcgacctcttttgtcacatctgtgtgagaggagctggactttctcagatatggatgagcctcacgacgcacatcctttcgtcccttgcttgtctaccaagtccctatgtgctccaggaggcagtggtacaggccagccgctccgtatgaccagagaaccagtgcctcacactccagcgcatttccttcccagggtgcaccaggactcttgtaaagagggcattctcgtgtaagcagttgctttttttttttttttttttaatttttatttttttgagatggagtttccctcttgtctcttaggctggagtgcaatggcacgatctcggttcactgcaacctccacctcgtgggttcaagtgattctcctgcctcagcctcctcagtagctaggattataggcacgcaccaccacacctggctaatttgtttgtttgtttgtttgtttgttttttgagatggagtcttgctctgttgcccaggctggaggacagtggtacgatcttggctcactacaacctctgcctcctgggttcaagcaagtcttctgtctcagcctcccaagtagctgggactacaggcgcccgccaccacgcccggctaatttttgtatttttagtagagacagggtttcaccatattggccaggctggtctcgaactcttgacctcgtgatccacccaccttggcctcccaaagtgctggaattacaggcgtgataatttttgtatttttagtaaagatggggtttcaccatgttggccaggctggcctcaaactcctgacctcaggtgatccacccgccttggcttcccaaagtgttgggattacaggcgtgagccacctcgcccaaccagcagttgctgtaaaattttttaaaaggatgtcacttatactacccagtcattaagacttcctgaggtggaaagatcacttcagcccatgagtttgagaatagcctgggcaacataatgagaccccacctctccaaaaaaatttaaaaattagggccaggcgtggtggctcatgtctgtaataccagcactttgggaggccaaggtgggtgggtcacaaggtcaggagatcgagaccatcctggccaacatggtgaaaccccatctctactaaaaatacaaaaattagctgggtgtgatggcacgcacctctagtcccagctatttgagaggctgaggcaggagaatcgcttgaaccagggaggaggaggctgcagtgagctgagatcgcgccgctgcactccagcctaggtgacagatcgagactctgtctcaaaaaaaaaaaattagccgggtgtggtggtatgcagctgtaatcttagctacttgggaggctgaggtgggaggatggcttgagcccaggagttcgaggctgcagtgagctatgatcacacgactgcacctgggcgacagagtggaggtgatgtgcttcctcaaatagccatgagaacaacgcttcttttcttgtcctggctcaggaacctcaccaccatgccacgttgccctgctgcgctgtgctggtgtcgtaggtcggtggcaggacatttgcccacctcacaggctctgctttcagtcttgaagtatggctcctctcgactgctgcccacacggcctcctgttgtcagcctgggctacatatctgggctcttccatccctgtgggcctggtgaggcctggccatgtgcctgtgtcatgccagttgctttcaagatgatgtttctagtaggaccacatgtgaacacagtgaccaccatggccaggaggaagctggctgcccatcaccagcttgcccagggacctcttgcaccctggcggggatcagcagatcctgctatgagagagcagaaggcagcatgctgacttccaggagtgtccacagcgtggctgggcagagcagagctacaaatgaacagatccagtgccgaggccatcctgactctctcaggggctgccaggccgtgggtgcagggtccagcaggcccacttgatcccagcatcccacgtgtgcctgctcggggtggccagctcactgcttcttcacctctagcccaaccagcaggtgccccaccatgagcccctccaggctcaccttgcccatccctgccatgtgacctgggactcttgagatgagatcacagctgcagagcacacagcacagggaggagctcatcagcatcttcccacctgtggtgccctggcccagcctccttccggttggggttggacccgccctggcagccaggttttgcgtcacctgccccacccgccctgtaacctacttgcccaactgctatcccggtggccgtgaggccagttgacagaatggagaggggtaagcattttccgcctggagaggatgggcgtgtggccatctgactgcttctgcaagcctggtggttgtgtgcaggctgccctggtggtcttagccccttggggcaggcggggtcctgtgcaggatgcagagactgggcgtggcttcctgcagatgttcagatgcttctgggctgtggcctctgagacccagggcaaggctgctgactggaccccagaccctcctgcctgcctcttcctccagctgctctttgtggtctggttctggccgcctgggcctcagggccaaccctgcatggctttgaccactctggccttcttggactgccaaggacatgctgagagttggttgggcttggcccaagtgctgagcccagggcaggggtggggacaggcagggcggagcctcacctggaaagccaggcacgattctccctgggacaccaaccctcctgtagagttggccaattcgggcaaccttgagggcgagctctgtgtggcacaagagatgccctgaggagcccagcctcacctggtgtgatgggacctgtggaagttgtgggaagtggtcctggccacccgtgtgcccacatgccctgcgcccagatcaagatatggtgaccaaaaggacaaggactatatccatggctccctcccagagcctggcaagtcagcaggcatgagagggtgttggaatgctgtggtgggcctgtgtggggaccttgtaggacctagggaacctgcagggcttggcttagggagcacacaggggcccaggcaaaggcaaggtcacaggtcgggggaggtgaagctggcagggggagggggagacctgctggctagagctgggttgggggccggtgggcagtgggcctggctcgagcagggggcgagggattggagagaaaggcagttcctgatggtcccctccccaggggctggctttcctctggtccttccctcccaatgaccgcgtcttcgtcgaggccacagcccttggctctgcgcccacacctccagtgccaggctgtccggagatctgtttatggccttcccttggaccatggagccctccctgccactggtgcctggagggctggtctgctgcccctgcaccctggccagctaggatggtggggtcctgcagctgaactgggggtgcctttctgcctgtctgtcctacgtgtatcagtggccagaactgccctcatccatggccttgccagcagctgggcgtgcagcccagggagggctgaggtcggctgaagttgattgagaccaacggccttctctaacaccccagaggagcatgtccctggtgagcaggccttgggcagccctgggctccaggccagtgggattccagtagagaccagctggcagggcttctccagtgactgcagccaggggttctcatgtgcaggaaagaccagctcctccagagtaaagggacttgtgtcttctggccacatggtgagtgctgggcccaccccatcagtggcaccttgggtgcactcccaaagcccagcgtgttccccatcttcctgcactgcattcgggatggttctgcatcatcagctgcacctgattgctcttaaacccacagctgagctttaatgtgcagtcactgaagctttcatttctaaaatagcttcctaagagttcttttggccaggcatggtggctcatgcctgtaatcctaacactttgggaggccgaggtgggtggatcacctgaggtcaggagttggagaccagcctgaccaacatggagaaaccccgtctccactaaaaatacaaaattagctgggcgtggtggcgcatgcctgtaatcccagctactcgggaggctgaggcaggagaattgcttgaactcggggggcggaggttgcggtgagccgagattatgccagccagcctgggcaacaggagcaaaaacaaaacaacaacaacaaaaaaaaaccgagttccttttgctgctttgtaaacccagtttgctcttcatcacttcctttgccctgcagatgtttctgagctgtctgttttctttctgccatcagagcatggttggttgatgatgcatgtacggttatctttctgctggttcttgctcatggtgcttctttcattatgtggttctttctgactatgtactgcttctggtctttgaaaaatgattttgagacttctttgaagtataggatgaaggtatctttctccagagagaacttcaggcacaggggcactacgagtgctggaaccccttaaaactgtgcttggcttgtgggtccttgtacccccagtgtggacctggacggctggctgtgccacagcttctcagaaacttcccttcacttatgtgcaatgtccccataacccctgggggtggctgcggctgtagttcatctctccctaagcatcgctctttggagtcccagcctaacttagaggagagtcttctgttaggttcttcatcctgtgggggtgactggaccttgtcttctgtctccttcgcccccgaggccaccagagtatgagccccagtgtgttcagtgggcaaacgctctcaggcaggattggccactgtgttctgctgtcctctgtgggccacgctctccgaactgttggccaaatgctgcatgagctcatcagctcctggcaatttttaagatgttttcatatttcatccagcatcttgagttgtttttaccaaaaggattgcccctagtagcctgcccaccctcggatgatggccccctgtgggcgcttccagggcacccggcaaggggacccaacccacttccagccccacagtctgcttcccacagggcccccttgcaacaacacaccctttagcttcccatcctatgcagagtggtggccagcagaccatctcaaatggctgcccatccccctgacccagtgcgtctgcacgtggcgcttattgctatcccaatacttcaactgcacagccaccagctcctcactggagcagatggtccccaatggccatccctaatgcccgtgcctatggaggcacatacactgagccctcttcacctccgtccccactcattagacttttctcagaggaatctttttgggtctcttcagtatttgaacagcttcttggctgtcccatgtcccagctgtgagcactggctctgccctggagccgtgtcactaaatcattgcacatgtgcacatttcagggaacttgggtgtcacccttgggtggcctcggaatctaatctccgttctgcactcgtttgcattgtggaaaactgcctgctctgggccccagaggtccctgggtggggacgaggtgtatgctaagtgtgcagtcacccagcgtgtccccggcacgtgtccatgccagctgctgtgggtgtgtggggccttcgggtcctgtgggatggcgagtgtgtgtgctgagcaggacctgtagggcctgcatcccaggtgagtgggccatgctgttggaggcggaggcagggctgcccccactggtggcgtgtggggtgggtttggtgctgttgcaggggaggagatgtgcatgtgggggacagtcttgaaggaagaatgtatacagtggtctatttccaagacaaagtgtcttaaattggcttagctcagcaaactacagaagaaacaggatatactaggccaccctgcttggatagctgatgtgtgcttgtcggcctccactttccccgcacttagttgccttcacccgaaccaaagaagttcagtctaagctgaaagtttactagcctgcaaaatagctcattttgtctgttcttatcagcctgcctgctacttaggtcgtaagttaaatacttaaaaagtccctgagctaactaggactgcaatgcattgtgggctgcaacaaaatacagcaagacaagcccccaaaaaaacacctgaagcccctacccaacaattaataggcgacgtccgggaaaattgtgaccccacagtactcggcctatgaggaactgggggagggacctgcgtactaggggataaattgcttgtcgaaactgtgctgggtgtgcctgtctgacacctgatcttgcaagactgtcattaaaagtctcactttcgctgttctctgggtctgagttcattctttagatttggatgggtaagtttgtttctcacagtgtggctcctgccctcacttctgctgccccccggggaccccctcggcaccccagctcggtgtgtccaggccttaagactaccatggtgctgatgggatgcttctgttcagggctggtgttgcaggtggtggagagacagtctggccagtgccaatgagtgcatgggtttgggagttgtttgtgtggcaccggccaagagtgtggtgtccagttcccccacacccagcaagtagtacagacaccacagaggtggttctctctgttctggcctgttgcaggttcggagggcagccctgagtgtctgccatccgctcaactcagtgttttccttttcccgcagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggtaggacagaggagtgacatgggtccaggtgggctgcagttctatgggctttgaggagggtcgggcggcagaactgggacaacggcgtcagtgagtgagagccagcttgggctggcgggtcacagctgctggtgagaagtcaaagtggcggccaggctaggggtctgtgggtgggtcctgagctgaggaaaaagaacctggggaagaggggacgctgaggaccagccagaggagtcaggaaatcgaggccagaagccacccctgaccctggactcaggacggccacacctccattccccaggacaccccagcatttatccacacagagaacgaggcagagatataacccacatctaaaatgaaacgtgtaaccactctctaatgcaactgctcgggaagttttcatcattttaaaatctgtaccagaaatgatttgaaccatttcaagagggtctcagatttgagtcactgcaaagttgcatagacaccatgctgcttgacttcaaggctgagtgaagtcatttcaggccaaggaatcaggaaggaagggtgtctggtgttttccctttttgcagttgggtgagtggcaggtcccagcagcagacagcatgctgcagggaaggtggaagaaatgttaggaaagaactattgactgctacagggactggagtagtgttgggctggctagtgagtgaacagaactctaaagaatgtaggggctggccgagcacggtggctcacgcctgtaatcccagcactttgggaggccaaggtgggcggatcacaaggtcaggagatccagaccatcctggataacacatctctactaaaaacacacaaaaaaattagctgggcatgggggtgggcgcctgtagtcccagccacttgggaggctgagacaagagaatggcgtgaacctgggaggcagagcttgcagtgagccgagattgcgccactgcactccagcatgggcaacagagcgagactgcatctcaaaaaaaagatgaaggtaaaataaggtcatgtgggtaggccctaatcaatgtgatgggtgactcagatacgcacaggggaagctggtgtgtatacagagatagaagcagtcgtctgcataccgagaagaccctcaaaaggagccagccctgctgacgccttgatcttggatctccagcatccaatgctgcgagacaatagtgtctgttgttgcagccgcctggtctgtggtgcttagttacggcagccccaggaaactagcacgctgaggagagccagccagctctgtatgcgtttcagggctgcctcctgcaggctgctgaagagactcaacccaccccgagtgctcccatctctggaaaggaagcttgatggctggcctgcgggtgctggtcagtgccacccagccccttgggtggagaggaggagggttgacatgggcccctcttgctttcactcagaacccgtgtgttgctgccaggacctgtcctgcgggtcctgccattccagttggcctcgggatttctctggactattttccgaagccctaagccaaagacgaaatgtgccacctctgggtgactgagcaaatgtgcgctgtgttttcctgacttcatgggagggtgtgagacacttctggtggctgcttctgctctgcctgtggggtgtccagccaggggaagggcacgctgcaggctgggagcacagacacttctatggagcccctgacagcacctctgcagcactttgggaggcctcgtacaggtacccagctaggctgggctggactcctcacctgtggactggagtaaaaagtagggtgctttaggccactatgttttttttttttattattattattattattttagagacaggatcttgctctgttgcccaggctggagtacagtggtatgatcatagcttactgcagcctcaaactcgccggctcaagcgatcctcccacttcagcatgcctaagtaactgggactacaacaccatgcccggctaatttttttttttttggtagagacaagttctcactatgttgtccagggtggtctcgaactcctgggcccaagtgatcctcctgcctcagcctcccaaaatgctgggattacatgcgtgagccaccatgcccggcctcggccactgtatttggtaatttgatacccatcacggaaaaccaagaccctgcagcaagataacacaatcacttcatgatgtcaccctatctctttcaaaactgcctgtttacagccgggtgcggtggctcacgcctgtaatcccagcactttgggaggctgaggtgggtggatcacttgaggtcaggagttcgagaccagcctggccaacatggtgaaaccccatctctactaaaaatacaaaaattagcctggcatggtggcgcacacctgtaatcccagctattagggaggctaaggcaggagaattgcttgagcctgggaggcagaggttacagggaactgagatagcgccactgcactccagcctggatgacagagtgagactccatcttaaaaaaaagaaaaaacgaaaaaaaacctgcctgtttacagccccacgtgatgccacttgctggcttcagcctagagtggctgcaggacaagctgttactccatgggacagcttccatggggtcaccactgagggtttgatcactggatctcaggccagagtacctcctatctgtcaccaaactgtcccccagacagtgcacacactcaccccccggcagaacacactcaccccccgagatgatgcacataccccccggacagtacacgcactcaccctgcctagcagcgtgggtgtcaggtggtgatggataattagtggtttcagttattggaacaaaataaagccgaggtgacttgccatcctcagggacctcaccgtggtgggtgcatccctgtctctctggacgtggggcgcagataggcttctacccatgtgcagccccaccagtgatgactgagagagctacttcctcctccctttggggcttgatctgggtgctcagcatgctggcttgtccctgaattatgtattcaatgaaatccctggcaaaccaccagcaattcagctaaacatgactgctggaacaaaaataacctggcaattaatgttcctgagttattaggcaaacatatataattgctccttgtttaaaaacagacagctgaacatcttaggacaaaagtccatgctcagtcagcttttcttcctacttttctcccctttattttccctttgtaagagcattatgtcagaatcagcacccgaagccaacagccccagcctggtttggggctggactgggatgaggtgtccctggctcccccgacccctgttcacctgcagggctgtgggacgtggaagcagaggaggaaggtatttaagagagaatgctgagcagaaccacatggagcttgaccccacccatagggtggaggagctgtcatcccagaccctggcacatccccaccatagcactcagggactgcggtgttcccccttctcctgcccgctggccaggacacaaccaatgggcacctacaggactggcccatccaggtctggggcaagtgcactgccttctactagcactgtccagcccagggaaggtgggctctcctgccatccctgctgcagaggttggggggcacttctgcccagaagggacatggagacttgggctgggtctgggttgaaacatggcagttagaggtacaaaggctgaggctcatcagggacagagaccacctccccctaccccaggcagcacatccctgagacctggtgcagccctggggccagctgggtgtcagaccaggctgaatggggcaccctggaggtggtaaggcttccatagcagaccccaagggctctagggcatggcacagtccctggcaatgaccaaaagcatttccccagttctgctggcaagaagcttcaggggcaggcactgagtggggggcacacatgtgcacacaggtgtgaatgcctccaagggcatgaatggtgggtgctagcaccatgtacttttttgtttgaaatggagtttcgttctgtcgcccaggctagagtgcagtggcacgatctcagctccctgcaacctccgcctcccgggttcaagcaattctctgcctcaacctctcgagcagctgggattacaggcgcccgccaccacacccggctaattttttttttttttttttgagacggagtcttgctctgtcactcaggctggagtacagtagcatgatctcggctcactgcaaactctgcctcccgggttcacaccattgtcctgcctcagcctcccgagtagctgggactacaggcgcccgccaccacacctggctaattttttgtatttttagtagagacggggttttaccgtgttagccaggatggtctcgatctcttgacctcgtgatcctcccaccttggcctctcaaagtgctgggattacaggcgtgagccaccgggcccggcctaatttttgtatttttaatagagatggggtttcaccatcttggccaggctggtcttgaactcctgacctcatgatccacccacctcggcctcgcaaaatgctgggattacaggcatgagccaccgtacccagctgtgagcaccactttcactcccaattttatgaatgtctgttatttcacatttaatcaggagcaaatgttgttttatgaaattgatgtgcaatgatcaatatggaaattatttttaaacacttgtcgggctctcaccactgcaacttggtttcagactcagattgtgatggcaggacagctgagctctgctccttggagctgcctctccggcacaagtgctcagggggtcttcagccatcactttttttttttttttagagacagggcttctctgttccccaggttggagtgcaatggtgcagtcacagttcactgcagcctcaaactcctgggctcaaatgatcctgctgcctcagcctccccagtagttgggaatacaggcatgcaccaccacacctgactaatttttgtattttttttttgtagatatggggtcttactttcttgcccaagctggtctcaaaactcctagcctcaagtgatcctcccactttggcctcccaaactgctgggattacaggtgtcatccactgtgcctggcccagccatcgcttcttagaccctcaggtctaatggacattgcaggaactgaccccttccactcagtcactgctgtgtccttatttgttttcttctaatgtccaagctgggacttgaaagtcagttttctttcctcaagaccagggctcttaaagtttagatgtctctcctaattccaaaagaaatatttgtttgattaggctggatgtggtggctcacacctgtaatcctccgcctcggaggccgaggcgggtagatcatttgaggtcaggagttcaagaccagcttggccaacatggtgaaaccccatctctactaaaaatacaaaaaattagctgggtgtggtggcgggtgcctgtaatcccagctactcaggaggctgaggcgggagaatagcttgaacccgggaggcgggagttgcagtgagccgatgtcacgccactgcactctagcctgggtgacacagagagactccatctcaaaaaataaaaataaataaaaatggaaatatttgtttgattcataatgcaaaaaaactagtaaaacagtgaagttcccatccactcccaaccaacccgagaaattaactccaaaacacacagaatggagcagccctcagaggcccacatgctgtgccattcaatctgtatccttgagctcacgcttccaagagcccacgggtttgttgtgggtgttcccagggctggggacagatggacagaaggaggaacagccccccaccctccagcctgggctcccggcatggagcccaggctccatggtgcccctaagggcctggcagacccgtctcccgccattgaatggtgtggatgtgtgtccctgcctagcatcctcctgtttcccgtgcggtcccagctgcaggctcccgagagctcacctggagccacggtgctccttcctccagtgtgggtgcagcaggactgccggcttcctgccctctctgagactggcccttgttgccactgaggccagttttgtgtgtgaaaagagaaaaagacttggctcgctcgtttccatctgaagccatcagtgatgctttcctcttgcaggctcatcttggcagccaacagggatgaattctacagccgaccctccaagttagctgacttctgggggaacaacaacgagatcctcagtggtgagtcttcctgcgtgctcagcggtggctgcgccttgttgcttccctagcccctgcgtggcccgagtgaccctaactgagtggtgctgcttccaagtgtgatggcggggtgtagaggtggaactgatggggctcgtggtcggggccagccccagcaccgggcattgccagagctgcccacccagcactgtctgcgtggcttcctgtgccatgcgtctgcatgggggccccatcatgtgaaagcatcagttggttttatatggatccctcctttttgctgagggcatgtgggtggatttgtgtgatgtacagatccacactcagtcactttgtgaagcaacccagtcatatgagtgtgtgcatgcgtgtgtatgcgtgcgtgtgtgtgcctgtgtttgtgtttctgtttgtatatgagcacccttgcttcagggatggtggggctgagtttgggaagctggtggtgctgaagccccgtcacctgcaccatgcctgtgttgcattaggtgtacttatagggcagaagtaggggtgagaaccaggtcctccccaccaaagataccagcctcattgaagtcctgttggacaggaaccagttcctgcccatggggtggtgggagtctacctggaaggtgcgcatagatggctggtgaggccacgggttactctgcctgcgtaccaggcgccaagtgggcccgaggcatcctggcatgctccagggtgcccactcaggccagatgtgtgacctcgtgggcccatggaggctgtgtgtgccctgtgctgcctcccaggccgggagggcaggtgttgggattataggtgtgaacccaacacttaaggaggctgaggcaggaggattacttgagcccaggagttcaagaccagtctgggcaacatggtaaaaccctgtctctacaaaaaaaaatacaaaaattagccaggcgtggtggcatgtgcctgtggccccagctactcaggaggctgaggctagagaattgcctgagcccggaaagcagaggtttcagtgagctgagattgtgccactgcactccagcatgggtgacagagcgagaccctgtctcattcaatcagtcaatcaatcaatcaaataaaagctcagctgtggggttttgtgaggactcctgtgtaggcctgtggcctggcagtagtgtgagaatgctgctgaggctgggtggtcccggcaccgtgtgggaggaggacgggtgcatggagactgaggcagggtggtcctaggcctgctggtataggaggatgcagtgggtgcagggctggtcaggacgggtgggtgaaggcacaagactgatgtccttggaaggtggaaggttttcatagatgaagatgtggcggctcagagggttaccctcttctggttccttgactattgtgccctcctgggctccatcccaccctggcacccaggtctgtcagctgcctctgaactagtgccaaccccagcagctccagtcttgtggaattgttcacccctgtggtgttttgatggtggcagctggtgcatggatgtacacgggcttctgccaagtgtcggggtgaccatatcactaaggcccacatcctctcactctctggcgtcaccggattgtatgcaaaagtttaggacagtggttctccaggtgtggtccttgggcctgtagcaccagctttacttgagaacttgttagaaatgaaatcaccctgggccggtggctcacacctgtaatctcagcactttgggagtccaaggcaggaggatcccttgaggccaggagcttgagaccggcctgggcaacgtagtgagtccctgtctttacaaaaaaaaaaaaaaaaattagccagctgtggtggcatatgcctgttgtcccagttactcaggaggctgaggtgggaggatcgcctgagcctggaaggtagaagctgcagtgaaccgagactgagccactgcagttagcctaggcaacagagtgagaccctgtctgaaaaaaaagaaaagaaatgcaaatcaaaatcattaaattcataaaaatttggccatcacttctttttttttttttttttttttgagatggaattttgctcttgttgcccaggctggagtgcaatggtgccatctcagctcaccgcaacctccatctcccgggttcaagctgttctcctgcttcagccttcctaatagctgggattacaggcatgcaccaccacaccaggctaattttgtatttttagtagagatggggtttctccatgttggtcaggctggccttgaactcccgacctcaggtgatccgcccgccttgtcctcccaaagtgctgggattagaagcatgagccattgcacccagcggccattactttttcaagtagtttttctgtcttctctctcactctctccttctctccagttacacacatatattagttcacttgcccttgtcccacacctctgcgatgctctctgcgtacttttctcggtgcccctagatcttgaggttttccagcctggtgtctgggagccagccctactccctgccctgtgtgagcactggtggttcttgccccagtgtcatatagtctcctccctgagatgctgatcagacattctctgtgtagctccttcctctctggacttttgtgccactgtcttagttcgtttgtgttgctctaaaggaaaaagctgagtctgggtaatttttttctttttttttgagatagggtctcactctgttgcccaggctggagtgcagtggcacaatcctgtctcactgcagcctctaactcctggcctcaagtgatcctcccacctcagcctccctagtagctgggactacaagtgcacatcaccatgcccagctaatttttaaaaataatttgtagcgacaaagccttgctgtgttgcacaagctggtttcaaagtcctggcctgaagtgaccctcctttcttggcctccgaaagtgctgggattacagataataagccatggtgcccagccaaggctgggtaattttttttttttttttttttttgagacagagtcttgctctgtcgcttaggctggagtgcaatggtgcgaccttggctcactgcaacctccacctcccaggttcaagtgattctcctgcctcagcctcctgagtagctgggattacaggcacctgccaccacaccctgctaatttttgtatttttgtatttttttattattattctttaagttctagggtacatgtgcagaacgtgcaggtttgttacataggtatacatacatgtgccatgttggtttgctgcacccatcaactcatcatttacattgggtatttctcctaacgctatccttcccccagcccaatttttgtatttttagtagagatggggtttcaccaggttggctgggctggtctcaaactcctgacctcaagtgatccacaaggctgggtaatttataaagaaaagaggtttatttggcttagagttctacaggggacctgaagcacagtgtcagcatctgcttctgatgcaggcctcaggaagcttctactgatggtggaaggggaaggggaggtggtatgtgcagatcacacacggagggaggaagccagagagagggaggaggcgccacgctcttttaaacaaccagttctcaaaggaactaatagagctagaactcatcactgtgaggacaacaccaagccgttcatgaaggatctgccattaggtagatctgtctcccattagaccccacctccaacactggggatcagttttttggtttgtttgttttttttttttttttttgagacagagtttcactcttgttgcccaggctggagtgcaatggcacgatctcggctcaccacaagctccgcctccaaggttcaagcaattctcctgcctcagcctcctgagtagctgggattacaggcgcctgccaccatgcccagctaattttttgtgtttttagtagagacggggtttcaccatgttggtcaggctggtctcgaactcttgacctcaggcaatccacccgcctcagcctcccaaaatgctgagattagaggcgtgagccacctcacccagcccggggatcagattttaacatgaggtctgggggacaaacatccaaactatggcagccatgaactctggttgtcttagtttccccaaacactaagcccctcttctcagctcagggagtctgctgaattcggcctggtccccccactccctgggctgggtcctggagcctctctaatcatgggctcactttgtttcctgtctgtcatatccttttttgtaaaacccatttgatatggtttggctgtgtctccacccaaatctcatcttgaattatagttccccaaatccccacatgtcctgggagagacccagtgggaggtaattgaatcatggggcattacccccatgctgctattctcatgatagtgagttctcatgagatctgatagtgttttgtttttttttttttgagactgagtttcgctcttgttacccaggctggagtgcaatggtgcgatctcggctcactgcaacctccacctcccaggttcaagcaattctcctgcctcagcctcctgagtagctggaattacagccgcttgccaccacgcccagctaatttttgtatttttagtagagatggggtttcaccatgttggccaggctggtctcgaactcctgacctcaggtgatccgcctgcctcggccttccgaagtgctgacattacaggcatgagctgccgctcccagccaagatctgatggttttataaggggcttttcctgctttgcttggaacttctccttcctgccaccatgtgaagaaggacatgtttgcttccccttctgccatgattgtaagtttcctgaggcctccccagccatgctgaactatgagtcacatatctttcctttataaattacccagtctcgggtatgtccttgtagcagcatgagaatggactaataaatacaccattgtttcttgagttttatttatttatttattttttggttgttttatgcaggagggtaaatctggtccttgttgcttgggcaatttggaagttttgttcttgttttaattattgatttgtaagagttatttacccattctggatatgagtcctttgtgcctactcatttccttaatgatagcttatggtgagcagaattttttttttttcttttgagtgggtggagtcttactctgttgccaggctggagtacagtggtgcgatctcagctcactgcaacctccgcctcccaggttcaagtgattcttctgcctcagcctcctgagtagctgggactacaagcatgcaccaccatgcccagctaatttttgtatttttagtagagatggggtttcaccatgttggccaggatgggctcaatctcttgacctcttgatctgcctgccttggcctcccaaagtggtaggattacaggcgtgagccactgcgcccggccagaatatttcattttaacaaagtacagtttatcttatcttttatgagttgttctttttgtgccttatccaaaaagtctttgcctacccagaggaaaatatataacaatattttcctccatttgcttctagaagcctaatttttgtttttatgtttggtctatgatttatctcaaggttttgtacatggtgtgaggtaggggttgagatttactgcctccaacccccaaatctctctagttgttccagcatcatttattaaatggattatcttttgcctagttcattactatggcaacttggttgtacatcagttgaacatatatgtgtgggtctattcctgactctgttgtatcccattgatctatgtatctgtcttgatgccaacaccatgcagtctatgagtgctgctgctttttagtaagtcttgaaatcaggctgagcactgtggctcacacctgtaatcccagcactttgggagaccgaggtgggcagatcacctgaggttgggagttcaagaccagcctgaccaacatggagaaaccccgtctctactaaaaatacaaaattagctgggtgtggtggtccatgcctgtaatcccagctactcgggaggctgaggcaggagaatcacttgaacccgggaggcggaggttgcggtgagctgagatcacgccattgcactccagcctgggtaacaagagcgaaactctgtctcaaaaaaaaaaaaaaaaagaaaaaagaaatcaggcaatgtgggtctgccttctttttcgggactattttggccatcccagttcctttgcatatgcatagatatttcagccagtctgttaattgctataaaacgaaaagccccctgggattttgactgggcaggttttgaatctatgggtcatgtggggagaagtgtcaccttaacaatactgagttgtctaagaagtacccagtgaaacaaataataacaagaagaaacactgttgaggctgggcacggtggctcacgcctgtaattccagcactttggaaggccgaggcgggccgatcatgagatcaggagaccgagaccatcttggctaacacggtgaaaccctgtctctactaaaaaaatatgaaaaaattagctaggtgtggtggtgggcacctgtagtcccagctacttgggaggctgaggcaggagaatggcctgaacccgggaggcggagcttgcagtgaactgagatcacaccactgcactccagcctaggcgacagagcaagactctaaaaaacaaaaacaaacaaaaaaacactattgaatctttcagtgaatatgcatgtctctccttaaatcaggtcagctcaacttgagaccctcaacagtgccctggagttttcagtctttgtcactcatttttcattaaatattttcctggtggtttttttttttttttttttttttgagacggagtcttggtctgttgcccaggctagagtgcaatggcgccatctctgctcattgcaacctccacctcccgggttccagcaattctcctgtctcagcctcccgagtagctggaactacaggtgcctgccaccatgcccagctaatttttgtatttttagtagagatggggtttcatcatattggccaggctggtctcgaactcctgacctcgtgatccgcccgccttggcctcccaaagtgctgggattacaggcgtgagccactgcacccggcttttttttttttttttaatcacactaaggattttaaaaatgctgttataaatggtatatttaaatgctcactttccagttcttgctagcatttacttattagttctaatacatcggttttggtattccttttgggttttcttcatatatgatcctgctggttgcaaatacagttttgttgggttttttttttttttttgagacagagtttcgctgagagtgcaatggtgtgatctcggctcactgcaacctccacctcccgggttcaagcaattcccctgcctcagccccccgagtagctgggattataggctgcctcagcctcctaagtagttgggattacaggcatgcaccaccacgcctggctaattttgtatctttaatagaaatggtgtttctccatgttggtcaggctggtcttgaactcccaacctcaggtgatctgcccgcctcggcctcccaaagggctgggattacaggtgtgagtcaccgcacggggccacaaatacagttttatttctttatttttgatctttacatcttttctttttctgttataattaattattgttataaaaataatatcttagggccaggcacggtggctcacacctgtaatcccagcactttgggacgccaaggcggacggatcacctgaggttgggaattcgagaccagcctggccaacatggagaaactccgtttctactaaaaatacaaaattagccaggtgtgatggcacatgcctgtaattccagctactcaggaggctgaggcaggagaatcgcttgaacccaggagggagaggttgcagtgagccgagagcacaccattgcactccagcctgggcaacaagagcgaaactctgtctcaaaaagtaataataacaataataaataaaataacatcctagccagtgcagtggctcactcctgtaatcccagcactttgggaggctgagtcgggaggatcgcttgagcccaggagttcgagacaagcctgggcaacacagcaaaactttgtctgtacaaaaaaatgcaaaaatcagccgagtgtgatggtacctgcctgtggtcccagctacttgggctgaggtgggaggatcgcttgagcctgggaggtggaggttgcagtgaactgtgtgattgccactgaactccagcttgggtgacagagtgagactctgtctcaaaaaaataaaaaatgaaataaaataataaaaataacatcttaatgacagccttttttgccccaatctttgggtaaaatgaccccctggtctaagaaggagccctcctgtggctttcagagccctccaaccttgtggcattagcagtggcccatgccctgcagatttggcgggggtgaaggtcctggttgtgtgctgggctcctagtgaagggcctgccctttgggcctggtgcatcctgctgggtgaggacagccagcgtccctgcaccccattcatgcgattggagcctagtgctgcccctcagccttgacgctggcccaagtggaaggatgtgttctgcagggcatctgttgggataggtgtggttggtgtcatagttgtcctgcaggacagggatctcacttgcacgacccatgaaccccaggggctgcctggccttgaagagttccagccacgattccatagctggggctgctgggccaagccgcatgtcgaacgtcctcgaggagcttgaggcaggagctgggccgagtatgcgtctcccagggctgggaaccaggtgggggactggaatgggtggcatcaatggtggtaacactgtcatctgccacagggctggacatggaggaaggcaaggaaggaggcacatggctgggcatcagcacacgtggcaagctggcagcactcaccaactacctgcagccgcagctggactggcaggcccgagggcgaggtaaggcgagtggggtggggccaaggtgagacagggtggggtggggcaggcctaggtgagacaaggtggggccaagggactacaggactggccaatgtatggtggagtggggcgggccaaggtaggaagtgccaaggtgcttgtgcttgggagtgggatggggcagggctgaggtaccgtggggcagggccaggttacagagtgggcggtgacaaagcgtggcagggcagggcccaggtaagggtggggacaagaagggggaagctgggccccgtggcaggtgggtggcttccgtgggcatatcactgccgccactgaggtgtgctgcaggggtatgcggcagagacaggaagagtgaggaggggagcatcccatttcccacaccctggccctctggcgtcgcagccaggagcccactcccacctgacccacgcagcactgtttactcctctcagggcgcactctccccttgtcctcatgcatggcactcctgactgctgtgtcactgtcccctgcctggaatgtttgtagagtagatgccttccccgagacgacagctctgtggacacacattgtccccactgaaaggtgttgtttacttcatgctggatttccataggaagacatagtggggaaattttttttttaataaaatgagcagttttcagtgccgacctgagtggcagccaggctaatgaggtgtggctgactcttgcggcagtcatgacaggccagggctccagtgggacccctcatcttcctgcatcctccccagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgaggtgggtctgccagagggggatggcggctctgcccagcactgcctcgggggcaggcctcaggctcatcaggaagtggggttccactgggggctgtggcagcctctccagggacgttgctcctcgtgacttggcaaacattctgaggactgagcctgtcacagatgtaccaactcgggtatttgggggtgaagcccaaggcttcctgtgatggcatgagggctgccggatccctggagaaagctgaggctgtgaagaacagtcacatagagtggctctggccgggtgtcctccctcccacgggcaggctgtgcagagcagccctccgcagccctggcttggagtgactgggatgctgtgctcccagggaagctcctgttggagatgaggccgcaggaactgcggaggttttggtgttttgcccttccgtgaagtgagcattcctccctcctgccctcctccccctccaaagccccagaacttggccaatgctgttagtccggggccttctgccaggacaggcaaacgggaagtggtcggcacattgtggcgggccctgaagctgcctccttccacaagggcaggtccatgggcctctctcctggctcccgagctccaggcctgctgttcgttgagcatcccttgtgtgtggcatgcccagccctgccccacatgggtctgcacacttgctatggaggctgggagagttgcagtgtcccctaggtggaaggccgagggctggtgcggggcacttgctgtccggagccgttcttcctgcccatgccttcgtgactccaggtggcagagcccctgtgctctctgcatgcccccatgctcaggaaccacttttcccggtcagtagttccatgtgggtctgattagtctcaggagagttcctctgcggccgtggcaccagcaggacttggcactcagcagctgtgtggaggtggggtgccaagggtgccatgccttgagcagatacacgggctcctgtggttgggggttgggggtttgggctcctcagagcctgtgcaactctcccggctccaaaggctgcagagtgagggtcagcctcctggacctagcctgaggatacaggcagtggccaggagagcataccacaggtcaggcaaaagctggtgccagggccgaggctggagggcgggggcatcggaggtcagtgagcagccctgctggtaggtgcagatgaggaagccaaggcctggaagggagagaggcttgtcatggccacagctatccctgggtgaggcctgccctccgcctggcctgtggtatagtgctggcagcatgggtgtccagttctgtaggtccttacacagaaagcccagaggagatttttgcctgcaaacagtctctgaaattatgaaccaagtatcttaggaaagttgccaaagaccatggtgaggaagaacgggagtggaatgtgaacatagacgggggggcccttgaagcctaccaggggtggggaaggtgggtcccacctgggggcagcacttcggggaggaaggcaccatgcctggctctttctctgcatctgttccatcttgaaggcccagggctccatgcccagcatctggcctgggagggcatctcacaggccacaaagagatcctcttcactttgcaaaaaaggcactccaagttctagaagacttactgtggtattgaggattggaatattttcagctggggagcattttgaactattttctttttaaaaaatgatttatttattttgtagagatggggtcttgctatgttgcccagtctggtttcaaactcctggcctcaagcagtcctccctccttagtctccagattagctgggactataggcatgagtcactatgcccagctctactgtcccttaactattttaaagtgtacacttaacacttgagagtaggaaaatgtggtctttggcgctttctttggaagcctcgatcaccctggggccacactggggccacctgtccagaaaccctcatagatgagctgtggtaaggggcctgatggagaggttggtgatgtggggatggggctcagccctgcagttgtccccatgggcagcctctgtgtgtccatgccatggggcattcggcatggcaggagggcattttagatcctgtgcctcctgggctggtgggccccgaggtgagctgggaacatacccgtgatgctggacaagagctggggcctccatgaccccgcctgccaggcacctgaggggctgggtcctgcaagctcctgacctggccgcagcgggctactgcgcacatcgctagcctccagaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtgcctgttccttctcagaacctctggagccatcaccacctggggttcttgcctggtctgctccctgacgcacaagtacacaccccactcaagccccacacagatgcacgcctcctgcacccagtccccagtctgatccccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccacgtggcatcctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacccatttaaagtgtatcattcagtaggtttcgtttcattcacagagttgagcaactgtcatcactacctaattccaggacatttcttgatccccaaagaaagccatacctgtcagcagccactccccattccccgtctcttcagcgcctgcaacctttaatctgctttctgtctctggatttgcctattctggacactttgtataaagggaatcctataatatgtagtttaggggactgacttttttcacttagtgttgtcgtctaaaaactcaccagtggcgaggcacggtggctgacgcctgtaatcctagcactttaggaggccaaggcgggcagatcacgaggtcaggagatcgagaccatcctggctaacacggtgagaccccatctctactaaaaatacaaaaaattagccgggcgtgttggcaggtgcctatagtcccagctacttgggaggctgaggcgggagaatggcgtgaacacaggaggcggagcttgcagtgagctgagatcgcgccactgtactccagcctgggcgacagagtgagattgcatctcaaaaaaaaaaaaaacaaagaaaaactcaccagcatggctaaatgatagaaaggagagttttatttgccatatcagtttgcagacccggaagagagagtctctagcatggactgaggtgctctctttgaagaggggaagggcagtttgagttttatgcctcccaaggtccatatcacacaatagagtcatacatattcagcaggtttggggaaaagccatacatatttatgaggggacccgagaacatatgcaatagataaacatacatgtaacatacatcccatgttcactttggggcagggttttagcattaaaatgaggtagaatctggatctttccatcagaaggtgagctctaggacacagttggagtgcagcctctatgaactgctgaaactggcttatggtctgtagttgcttatcagaaaagagtgtttgaaggctggttctctgtccagtcagggttgtggtggtctgggctgtcaagagttaggagggtctgataacgtgtgtgatctctactgttgtgagggagtttatcaagactgtggtttttcttgtagctgtaggaatttagggagttgctgagacagctgccctgaaccctcgagccagttggtactttttgtttcttccctttatccattaatggacacttgagttttttccaccttttggctgttggaaacagtgctgctcacagtgtgacctcacagcatttgtgtggtcatatgtttttatggctctcatgtgaatacgtaggaatggagttgttaagtcgtatggtaaccctgtttaaccttttgaggaacatccaaactgtttgccaaagcagccgcagcattatacattcccaccagcagtgtatgcgggttgcagcttctctgaatcctcaccaaaacttgctatgttctgtgtttttgatgatagccacgatagtgggtgtgaagttgtgtggactcgtggtttggtttgcgtttctctgatggctatgatgttgagcagctattctcatgctcgttggccatttgtatgtcttctttggagaaatggttattcagactgggttgtctttttgagttataggagtgacttatacattcattctagctacaagtctcttatttaaagcacaaagcttaaaatttttaagtcctatgtctctctctttttttttcttttgttgctcatgcttttggtttcttatctaagaaaccattgcctaatctaaggtcatgaagctttccccaatactttcttcttagagttttatagcttttgctctttcacttaggtctttggtttgacttaagttaactatttttttttttttgagacagggtctggctctgtcacccaggctggagtgcagtggtgcagtcatggcccactgcactgtcaacctcctgggcttaagagatcctcccagccgggcgcggtggctcacgcctgtaatcccagcactttgggaggccaaggcgggtggatcacaaggtcaggagatcgagaccatcctggctaaaccggtgaaaccccgtctctactaaaaatacaaaaaattatccaggcgtggtggcgggtgcctgtagtcccagctacgtgggaggctgagacaggagaatggcgtgaacccgggaggtggagcttgcagtgagccgagattgcgccaccgcactccagcctgggcgacagagtaagactccgtctcaaaaaaaaaaaaaaaaaaaagagatcctccctcccaagtagctgggactgcagatgtgtgccaccatgttcagctaacttttatgttttgtagagataaggcctcactattttgctattttgccgaggctggtcttgaactcctgggctccagtgatcctcctgccccagcctcccgatgtgctgggattataggagtgagccacctctcttgacctgagttaacttttgtgtatggtgtcaggtagagtccaactcccttctttgcccatgactatgcagttcaatggtcttccatgttgttcatgatggaaaaagcactgtgacacctggggctggcggcttggctctgggggccccagcagagccaggctgtctccctgggaaatgcctcggccaagatattctcctggaagtctgacagggagagggtggtgtcttggtctccctggtgcatcatttggggtgcttggctcccatcaagcccacccctgctgccctggcctctagagaagagcctctgaggtgaggtgcttctccacctcaagtccctgcccttcactttctgtgacatgagaaacccttttcctgttggccatgccttctgccaacactctgggagcttgttcagagtctgtgcagagccccccggctctcctaacctggggcctggctggtacgcagaggtgggccatgctctgctgaggcccagcctacacctgtgcccactgtgtggcgctgttgggggttccccaaacagggacatgattgtggtgggtgcctcctggcctctggtggctaattctcccactcttgaacttctcaggtggccccccaacctggcgtgaggtgaagaggttccctcttggctgtcccctttgcctgtgagatctcaggttgctcatttcttattcatccatccatcgaggctgctgggcatctgtgccttgtggtctcctgtgggtgcccgcttccgcctactgctgagttctcctctccttgccatgccatcaggtcaggaatgagcatggggaaggagctggagcatggagcggcttggcctcagtctggcctgatttcatggtccccagctgtaccccgtgttaggtgggtggcaggtggcaatttgccctgacatggcacagcagggcctctgcatggcccgctgattgctcctcacaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaacaccagggacttttgatgacagaagatgggcccaggcccaggcccaggcccaggggaggctcagtgcacccagaggcttgatgcagccacgtggggcccagagcagatggatgctcccctctgcatgccgagagcttgtgggaagttccagaagattctagacactcagcaaacccaggcggaagagacacatcatggaaatgagtggctagggtcagcacgctcagggttgatgggcttcccgcaagcggtctgtccccagcgaccctgggctgagtgctgggcagggacttgcagttccgggaactgcctgggtgtaggagctcccacccacttccttgcccgtaggcctcaaggcccctcaggggccaggcactggggtcttcgttgccccagccgggggtcctggtgcttgccatgccagcctttctcccactgggcgagatgccccacccatccctcgctccccacccaggtcagaccactgccctgcccaggtgatccagcgtccactcccaccctgtccagcttgcccccttcagagaagcacccatggaccatctcccactcctccccctggggcccctttctgccccctgcctaccctccttctcctctgggcctctgataggcggcctcgtccttcagcctcagcatcgctgcctcactggaagagccccacctgggcatgcccagcagcccctcccagctgtaagtccacacagcccccatcaatgtgccatctggggcaggccgaggaccggccctggctgccctcactgatggctggagccccgatgctagctacaatggctggcttgagtggacttctgtcacagaggcaaatgcccacagggcacctcttggggcaggcagggagcttgtatgtgccatctggggccaaagctccacgattgagtcataagttaagggtagatggagattttccgccttgagcagaaacgtggaggaaacacgcctggtgtgtgactcacgcctgtaatcccagcactttgggaagccgaggtgggcggatcacctgaggtcaggaggtcaaaaccaacttggtcaacatggtgaaactctgtctctactaaaaacacaaaattagatggctgggtggtgcacgcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaaagaaaataagagaaaagagaagagaagaggaaaaagaaaagaagaaaagaaacaacccttgcagttccccggccactccccagagccagttaggccaccaggtgggctggggctagacccggctgcgggcgggccacagagggactaatggccaccacttctctccatcctgcaggcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcagggtgagcagataccacaggctcccggggccccacaggctgggcttaaggagccagtacacagccacacagggccaggatggcttcagggctgcctgcacattggtggatccctgcgggcaaacgccccggcaccatggcactaggcctgcaggctgtacccttgggtggtggctgctggccagcctttcctgcctggggctggctggcccattggcaggtgcagggtgtcatttccttcagcccctcctctgtcataggctcatcttcctgtgtgtgaggggaaggcaagtgccaactccactccctggcaggccgcatagccgctgggtcccaccccacggggtgcactgcgtatgtgtctgccctgggaaccagcctgtgctggggctgttgggggatccagggccaccctccgtctgcaaagcccacggcagagagggttggaggagaggagagtgtgctgaatgtttgcttcaggtgggctggcatggcctgggcagtggaagagagggcacaggagggaagccttccagacagaggaggcctgggccccaagtggtcaacagcttgacctcttggaagaaccaagcatggctgtgtctgggaacctgggcctccaaaggggaagtgtgtggtcagcccgcaggctgccctatgccttggctcatgctacacggggagagcagggcagggtggggtggttcccagtgaaggtggcaggactcagcaagtgtgggcctgtggagccagccaagagctcacacgccactgatggcccctcatcatccccaagactgaggctgctgctctctgtgacttggcacagcctccaggcatggggttcctaactctacctgcctgcattcttgccctatttgtggctgtgacaggcagggcagggctgagggacaccaggtgaacgagggcccctgctctctttcagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccccactggagcgggaggcaggctggcctggacttctgttggatgatgggggccaggggatggtaggaggggcaggagagcaggtctgcatctgtctcagccccaggagctcctggtttggggccagctctaaggagcttcatccctgagcctggccgagtataagggggtcccggatatccaatgctgagacctagacttttctaagcctctgcacccaacccctaacttggccttttcagacccatgagagtgcagggtgggtgtggacctgcgccagggcttcccagcctgattgtgacatgatgtgagtccacctagggaggagcaggggcctccccgtctcttccccttcttgcccagaccactttgctgggctcagagccttccatggctcactttgaactcagaagagtttcccagctgcgacccaggctgcacccccaggcctgaggagaaactgaggccccacatcccatacgtgtcctctgagtcaggacaacaggctcccggctgggggcactgcccttgctgccaacacattcacctgccccagtggctaccatgtcctgtgccggtgaccagtgccagtccccaacctggatggtgccctgccctcatgaagagccccccggatgttcacctctgcccagagacccggcctgcccaggaagagcagtctctgctcttgtgtgggtccctctgcccccaccctgcccagggctccccagcagcctgaggcccctaaggaagaacagccctcaatggtgattctattggtgttatgagttgtgtccccaaagagatatatcagtgtcctgacccacagtacctcagaatgtgactgcatttggagatagggttcttccaggggtaaccaaggtagaatgaggtcgttagtgtgggccctaatccaatatgacggctatccttataaaaagaggaacatttaggctggatacagtggctcatgcctataatcccagcaccttgggaggctgaggcaggaggactgcttgagctcaggagttcaagaccagcctggggcaacatgtcgaaacgctgtgtctaccaaaaaaaaaaaaaaaaaatacaaaaattagctggccattgtgactcacacctgtagtgcgaggctgaggtgggagaatcgcttgaacccaggaggcagaggttgcagtgagccaagattgcactactgcactctgcctgggcaacagagggagactctgtctcaaaaaaacaaaaaaggaagatttgggctgggcgcagcggctcacattgtaatcccagccctttgggaggccaaagctggaggactgcttgagcccagattagcctgggcaacatagcaagaccccatctctaaagaaaaatgaaaattaaaaaattagcagggcatggtggtacacacctgtagtcccagctacttgggaggctgaggtaggaggatcacttgagctcaggaggtggaggctgcagtgagccgtgattgcaccactgcacttcagcctggatgatggagaaaaaccctgtctcttaaaaaaaaaaaaaaaggaaaaagaaagatttggacacggacggatacgcgcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtgatgcttttttttttttttttttggagacagggtctcactccattgcccagactggagtgcagtggcaagatcacagctcactgcagcctccacctcctgaggtcaggcaatcttcccacctagtcccctgagtagataggactacaggtgcatacgaccacgtccagctaattttttgtattttttgtagagacggggttttaccatgttgcctgaactggtcccaaactcctgggctcacatgatcctcccaccttggcctcccatagtgctgggattacaggtgtgagctactgagcccagactgtggtgctttttttttttttttttttttttgagacggagtctcactctgtcacccaggctggagtatggtggcacagtcttggctcactgcaacctccacctcccgggttcaagcaattctcctgcctcagcctcctgagtagctgggactacaggcacctgccaccacgtccagctaattttttgtatttttagtagagacggggtttcactgtgttagccaggatggtcttgatctcctgaccttgtgatccgcccgcctcggcctcccaaagtgctgggattacaggcgtgagccaccgctcccggccgactgtggtgcttttttaaggcggccctaacagactaacacagtagtgatcttcactttacagatgaaggaactgcggcttggggagataccataacggccccccggttccgagacaggtggagaggcagaaccatgggccaggacagaataggatgagtacaaggtggcatctctgggggtgcctgccccacagatccatggtcttcccatgctggtgtccccacaatgtctggcactgctccccgcttcaccttacttgcccaggcctacccccataccctcagctcacagctacacactctgcacagctcccaccccagggtctttgtgctcacagttcccctgcagatacccaaaccacactcttcccccagttcctgcaggtctttactgaagtctcgggcaggcaactcatttaaagtttcagtttagcccagcacggtggcacacacctgtaatcccagctacttaggaggctgaggtgtgagcgtcgcttgagcccaggagtttgaggctgtagtaagccatgattgcacgactgcactccagcgtgtgcgacacagcgagcccccatcttgaaagaaagaaaaaagaaattaaaaaggaggctgggcactttggctcacacctgtaatcccagcactttgagaggccaaggtgggcagatcacttgagttcgagaccagcctgaccagcatggtgaaaccccatctctactaaatatacaaaaattagctggacatggtggcggatgcctgtaatcccagctattcgggaggctaaggcaggagaattgcttgaacctgggatgcggaggttgcagtgagctgagatcgtaccactgcaccccagcctgggtaacagagctagattgtatctcaaaaaaaaaaaaaaaaaaaaaaaaaggaaggaaggaggaaggaaagaaggagggaggaagaaggaaggaaggaactctctttttctctatggcaatgagcacgtaccatctggcatgctgtgtgctaggattggttcttgcctgtctccatcagaatgggagcttcaggaaggcagggaccttccttctcttgcccactactgtactctgatgcccaggccaggcaggcatttgagccaagaatgacagtgctggtgcttcccaagcccccatctatttgggccaaccccttgatgcaaggcccttgtgctaatagagggtataggggtccaaagccagtgccttctagaagagctttggacgtgacaccaggaatggctgggcctggacaatggccttcctggcactgcccagccagtcctctgtgcttgttgccagatgcacctgatccctgagtccccagcatgggtctctttctcccaggcagatggggaactcaccttcttctcagatgccccttcccaacataagctgcttctgccctctggccccgagatggccaaggtgagctgtgtagacatagagtctggaggcatggggctggctaacgtggaggcaattctatgaacagacatggccaggccaggaatgcggcatggcctcaggtctcatccttgaaggcctgggctcctggtctgcctgcagacttcctgagaccacgtcttgttctcatctgccagcagatgcctggctcatgggtgagccgggcttaggtggaaacacaggagcccagaggggaaaggatcctcccccagcttgggctggagtcccaacttccaatcatcaatctttgcaaccctggggctggacctggctagttccatggtaaggatccttctccgtcacccagtcagtcccaggctgtgtgggaaactggctgtggtgggcaggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctggacccagaccctccagggcatggagcccattgtgaggtgtctggtgctgaagtggtgggggaggcccgtgcaggcctacagctttgtcatctgcaacattcctctccccactttctttaaactttttcatttagaaatgatttcaatggccaggcgtggtggctcatgcctgtaatcccagcactttgggaggctgaggcgggtggataacctgaggtcaggagttcgcgaccagcctgaccaaaatggagaaaccttgtctctacgaaaaatacaaaattagctgggcatggtggcacatgcatgtaatcccagcactttgggaggctgaggcaggtagataacctgaggtcaggagttcgcgaccagcctgaccaaaatggagaaaccttgtctctacaaaaaatacaaaattagctgagcatggtggcacctgcctgtaatcccagcgacttgggaggccgaggcaggagaatcacttgaacccgggaggcagaggttgcagtgagccgagatcatgccattgtcctccagcctgggtgacgagagtgagactccgtctcaaaaaaaaaaaaaaaaaaatgaaacctcgtctctacaaaatatacaaaaattagctgggcatggtggcaggtgcctgtaatcccagctacttgggaggctaaggcaggagactcgcttgaacccaggaggcagaggttgcggtgagccaagatggcaccactgcactctagcctggtgacacggcaagactccatctcaaaaaaaaaaatttttttttcaatttactaaaggatttaaaaagtagaacaaaaaattctagtgtctttcacccagttaccccaaatgtgaatgccgcacccaatcacagaaaaatgattacaaccaggaaattaacactgataatgttaaagaaagaattactgaatgacatttgctaaagcactgtagggaagactttattcaggaccgtcttgctaggtctagggaccacaggaatgagattctgcagtgggggagagagattaagctcaagtccgaatgggcaagtgggaactgatgatagctgaggagcagggcggtgggagctgggtcagcacatggaaaatgactaagaagaaacaccccgggtgagggagattctggctacaccaattaacaggatttttgctgaagacaggccacagtgaccggacatcttcacctgggggacagtgtaggaacggattagataaggagggtgatcagatgtcgagggtcaggggatgcttcttgctaaagtgactttgcagggttcttgctctaagtgaaatttacaaggaagtgcacagatgggcctagaagaaggttcagaagcctggtttggccaagcaaagaatctttgtcggtccctcctcttgttcaaggaaagaagaggttatctttccttgaatagtacgagtccatttccttgctgggctgccttttgttcattaaaggccagctgaatcatctgctgggaccggcagtagaggagatatcctccatggtgtgagccatcaggcgttgcatgttgaagataaaagaaaaagatattagttggaaccaactataaactcagtttctgagttcagagggcagctactcaagatttccaggtgctgtgcttgaagcatcttcagatggagtaggggctaacagactatcatggacggcagtttgcgtgtcatgaagtctgcccacaaattatctgttgtggtgccatcttaaagtttctttctttttttttttagacagagtcttgctgttgttgcccaggctggagtgcagtggcgcaatctcagctcactgcaacctctgcctcccaggttcaagcgattctcttgcctcagcctccagagtagctgggactacaggcacacaccaccatgcccagctaatttttgtaatttttgtagagacggagtttcaccatgttggccaggatgatctcaatctcttgacctcgtgacctgcccacgttggcctcccaaagtgttgggattacaggcgtgagccaccgtgcctggcctaaagtttctatcaagttgtccgggttcagcttaaagggcttcaggaaatgggaagttttaatttttagcggttccaggccagaagggtgggaaaaaaactggaaacatcagtttagagaaaatcaaatattggaggaaactagaagaattcaggatccaatccagtttgtaggtaaatatcaaaacctcaaaaacaatgaacagggctagaatctgataatgggtgcactatagttttcttctgaaactaatttttctctatatagtcaccccacttctatcaaagatgttgaagtaagactaatttgtttgtagctaagtttaggttgattaaacttggcctaattacttacataagtgccgcaacaatagtgattgaacacataggctttctttaagtttcctttgctaggacttttttttttttttttttttttttgtcacggagtctcgctctgtcgcccaggctggagtgcagtggcgtgatctccgctcactgcaagctccgcctcccaggttcactccattcccctgcctcagcctcccaagtagctgggactacaggcacccgtcactatgcccggctaatttttttttgtattttttttaatagagatggggtttcaccgtgttagccaggatggtcttgatctcctgacttcgtgatccgcccgcctcggcctcccaaagtgctggcattacaggcgtgagccaccgtgcccagcctgctaggacttttaataaggcatctcagattgggcttttaaaagccttgccaggctaggaagccaagccgaagcttcaccatcatacttcatttgcaatcattataggtttgggtgaattcctctctttttgaggtcccccaaaatatcctgacatccttgggcctgtcaggaagtgactttccttactcacctacaaggcaaccacatgacccatgtattcaaggtttaaaacccatttttccccaagggctttattggttccataaagtcatcttagttacttaaagttgtctggccatagctaaaaatatggcattctagtcaaagctttggtaatataaacagcatttccaattgtgtcctgttacaaagagaacaggttcttactgaacttatgtaaataaccatattgccattaaaataaaaatactcatgaatagtttccgaattatggaaggataaggtacagagaaaaagtaattgtttcacttttgtttacaaaggcatactttaccaaactgctgtaagctatggataacttaaaagagaaaaaaaagtttccttaaatctggaaaacaaaacattaaagaaccagcaatgtttcaaacaaaacataaaaaaattatcctggctgggtacagtggctcacacctgtaatgcttagggaggctgagatgggaggatcatttgaggccaagagtttgaaaccagcctggtcaacatagtgagaccctatctctacaataaaattaaataaataaataattgtaattggtttattcattgccatgtaatttattcttgttctgtttgatcttgatcagcagtttcacgaacccctcagtgtcttcattcaagttctggaaattctggccaggtgtggtggctcacgcctgtaatcccagcactttgggaggccaaggcaggcagatcagttgaggccaggaatttgagaccagcctggccaatatggtgaaaccctgtctctactaaaaatataaaaattaacagggcgtggtggtgggcgcctgtaatcccagttacttgggtggctgaggcaggagaatcgctggaacccggcaggcagaggttgcagggagccaagattgcaccactgcatgctggcctgggtgacagagtaagactatgtctcaaaaaaaaaaaaaaaaaaagagttctggaaattttttttttttttttttgagacggagtgtcagtcacccaggctggagtgcaatggcacgatcttggcttactgcaagcttcgcctcctgagttcaagtaattctcctgtctcagcctccagagtagctgggactaaaggcacacaccaccacacccagctaatttttgtgtttttagtagagatggggtttcaccatattggccaggatggtctcaatctcttgacctcgtgatccgcccgcctcggcctcccaaagtgctgggattataggtgtgagccactgcgcctggccccagccacatttcttaagtaatcaaaaacctaataaaagacaatatgaagaacaaggaactatcttgatataacacaaaaatctttgtttccaaggtcaattatttaaaaggtaaacagaggccaggcgaggtggctcacgcctgtaatgccagcactttgggaggccgaggcgggcggattacgaggtcaggagatcgagaccatcctggctaacacagtgaaatcccgtctctactaaaaaaatacaaaaaattagccgggcatggtggtgggcgcctgtagtcccagctactcgggaggctgaggcaggagaatggcgtgaacccaggaggcggagcttgcagtgagccgagatcgtgccattgcactccatcctgggcgacagagtgagactccgtctcaaaaataaaaagtaaaataataataataataataaaaggtaaacagaaatcttcataatctcaaatactgtaagaaaactttgtcatttcaacagagaagatcaagttaaagttctgcatcatagcactactaataaagctaattttaacaaaaccttataaatgaatccatccaatctcatgcaagataatatttcttttccaagatttcttttctatagatcttttacaacttaaaaaaaatatctggccgggcacggtggctcatgcctgtaatcccagcactttgggaggccgaggcgggtggatcatgaggtgaggagatcgagaccagcctggctaacacggtgaaaccctgtctctactaaaaatataaaaaattagccaggtatggtggcgggcagctgtagttccagctactcgggaggctgaggcaggagcatggcgtgaacccgggaggcagaggtttcagtgagtcgagatcttgccactgcactccagcctgggtgacacagagagatgccatctcaaaaaaaaaaaatctatcagtactttttttcccctacattttttttctttctcattctggaacaaccagttgctatatatattagcacagagtcagttattcctttaagggattttataaattaatttggtgctactatctggaggtagaaaaatatcatgtatatataacatacaaacatacatatgtagttgctctgcaactgaagttggcagaggccagacccagtggctcacgcctgtaatcccagcactttgggaggccaaggcaggcagatcacttaaggccaggagtttgagaccagtcttgccaacatggtgaaacctggtctctacaaaaatacaaaaaaatcagctgggcgtagtggcgtgcgcttatagtcccagctaccttggagactgaggcaggagaatagcttgaacccaggaggtggaggctgcagtgagccgagactgcgccactgcactccagcctgggtgacccagtgagtctctgtcttaaataaatacataaataaataaacaaacaaataaataaagttggcagagtatatagtctgaaggggtttgaggaaaggggattcaggtgactgagaagttccgatgggagaagtaggatccaatagagagaacagagaggcctcacagtgggaagaaaagactgccagcccaggagtcagggagtgaatccccattcagaatgaagagccacaaggaagaccttccaacccaggaagtattatacctttcaaaagaaggctgggaccttaaaaatcaaaatctgtccttaccagctaaaataaaagtttttctacagtcatggctcaggagtttgactcaccagtagatccccaatcagccagtcagaagacaaaggctgcaaagttgcacattgagagtcctgggtcagaggcctgtggcaccacaaccattaaagaaaaaaattattcagcccttgtcaaagcacggtcgggaaggccttattcaggagcattgccactggcatatggaccacaggcaatggggttttgctgcaggggagagattgggctgaactctgaatacagcatggacaagtgtgaactgatagccaaggagcagggcgggggtcagtggatgaaaaattactaagaagaaacataagtgataagggggatactggctaagctgacctaagaggattcttgctgaagacaggctggggtgatcagacatcacctagaggatggtggagggatgaggaatttcatcagtattgagggcgatcagatatcaaaagcagggtggttcttgctaaactggaattctcagacgggcctagaagatttaggagcctgactaaagtttggccaagcaaataatcttttgtcaatacaacaacacgatactttttactgtttgttttttttttttttttttttttttttttttttgagacagagtctcctgctgtctcccaggctggagtgcagtggcgcgatctcagctcactgcaacctttgcatcccgggttcaagcaattctcctgcctcagcctcccaagtagctgcaactacaggtgcgtgccaccatgcccggctaatgtttttgtatttttagtagagacggggtttcaccctgttagccaggatggtctcgatctcctgacctcgtgatctgcctgcctcagcctcccaaagtgctgggattacaggcgtgagccaccgcgccaggccaatacaatagtattaactaatctacagaccttgtttgaattatatcaattgtcccattaatgtcccttttctgagccaggatcccatctatcgtctggattccacactgcattttgttatctcttttaattgaagatggctcctcagtccatctttgacttgaatgatctcgatacttgaaaagcactggctggtaattttgcagaatgcccctaatttggggtttgtctgctcttcattcagattctgccttttgggcaaaaatacccacaagtgaacttgtgttcttctcaggaggtccacagtatgtcctcttactggaactaacttttttcatttctattgaggcagaatttatatacaatgcaatacacatgtttaaatggtacaatttgctaagtttgctggtgaccttgatggcttggttaaaggtggtgtcgcccaagttttcttccactctaaaactactattttccctaggcaattagtatcctgggggagaaactttgcaacactgaaaacaaaacaaaacctgtttgtcatgtttttgcccactatttttttttttttttgagatggagtctcactctgtcacccaggctggagtgcagtggcgtgatcccggctcaccacaacctctgcctcccaggttcaagtgattctcctgccttggcctcccgagtagctgggactacaggcacgtgccaccatgcccagctaattttttttgtagttttagtagagacgaggtttcaccatcttggccaggatggtcttgatctcttgacctcgtgacccacccgcctcggcctcccaaagtgctgggattacaggcgtaagccactgtgcctggcctaatttttttgtagggggttgggggccggggaccgagtctcgttctgttgcccatgctggagtgcagtggctggatcttggctcactgcaactcctgcctcccaggttcaagcaattctccagcttcagcctccgtagctgggacaacaggcacctgccaccaagccctgctatttttttttgtatttatagtagagacagggtttcaccatgttggtcaggctggtctcgaactcctaacctcaagtgatccgcccgcctcggcctcccaaagtgctgggattacacgcatgagccactgtgcctggccttgctcactattttttctggagacggtctcgttctgtcacccaggttggagtgcagtggcccgatctcagatcattgcaacctccacctcccgggttcaagcgattctcctgcctcagcctcccgagtagctgggattacaggtgcctgctaccacgcctggctactttttgtattttcagtagagataaggtttcgccacgttgcccaagctggtgtggaactcttgagctcaggtgatccgcctgcttcggcctcccaaagtactggggttacaggcgtgagccacagggcccggcccactatttttatcactcaagattttcgtctacagcagctattattggggtggctacccagtggaaaatttttctatttccactattccttccacatttattgacaggaaagctagtctaaggaagagctgtaccctcacttactcagaccctcgttttccttttttttttttttttttttgagacggagtctcactctgccgcccaggctagagtgaaagtggtgctatctcggatcactgcagcctggaactcctggactcaggtgatccttccacctcagcctcccgagtagctcggaccacaggcgcccgccaccacgcggctaattaaaaataattttgggcccggcgcggtggctcatgcctgtaatcccagcactttgggaggccgaggcgggcagatcaattgaggccaggagtttgataccagcctggccaacatggtgaaaccccgtctctaccaaaaatataaaaattagccgggcgtggtggtgggcgcctgtaatcccagttactcgggtgggtgagccaggagaatcgcttgaatccgggaggcaaaggttgcagtgagctgagatcgcgccactgcaccccagcctgggagacaaagcgagacaccgcctcaaaaaaaaaaaaaaaaagaaagaaaatttgtagatactgggctctcactatgttagccaggctggtctcgaactcctgggctcaagtaatcctcctgactcgacctcccaaaactctgggattacaggcgcaagccaccgtgcccggccgaaccaccgtgcccggccgaaccctccctgttttggaaatcctgtattagcaaaggggacagcgccagacagttgagcacacgcgttctttataaatgatgatgtctgatacagtgatgcttttaacagggttgtgtaacgcctgtgtgtgcacggtctcttctgcagtgtccaccgaaggtggcccgtctgcgtgtccgctcccggcgtactccgcgctccctgttcccggcattccccgcgctccccgagcttcccgcgctcccctgctcccggcattcccggtgcttcccgttcccggcgctcctcgcggccgccgccctcagtccagcgagccccgcctgggcagcgactgttagcgcgaccgcggcctgggcgcctggtccctcccgcgcggccgcgctattgggccgcgcgcggcggacacacgcgctacgcgccgccgattggcggcctccgcagcgcgctctgcggctcccccaatgcggggcggccgcgcgcggggattggccgcacgccgcgaaggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcggctaattttttgtatttttaatagagacggggtttcaatgtgttagccagggtggtgtcgatctcctgaccttgtggtccgcctgcctcagcctcccaaagtgctgggattacagtcgtgcaccaccgcgcccggcccagagtggttcttttaaaccataagatggtataaaacagaggcggtgtagatgcaagccagcttgcctgcttgtaaagcagctccatcacttcctggctgtatgaccttgagcatgtgggtgaacctttcttccataatgctatgtgagacctgggtgagttaaaatgcttaaagtgcttagaacagggcctggctgaggtttggttgccactgctatcctggaatcagctgatgccactgtgtgggccttcctatccggtggcccatctctctcactaagagccaaagtcctggcagcagcctgggaggaccagccctgatccatctgccctcatggacttggcccactgtcacgtcccctcagcacactgccccagctggccacaccacattcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgaccatcagctggagggtgtggagaccaagggcaaggtgggtacacagtgagatggcaggtgatagttgtgatccaggttctagtcctggaccaagtgtcacaggaagccaccagaagcaagtggtgttacctgatttttgtttaacaacatggcttctgggccacagcatggtgtgtgcacttcagctgggcagggtggaagtgccctggtcgacgtggcacttcctcaactttgagttgagggtagtggggagagcacttgagaggcgcccagagttgcactgtgaggctctgtcatcgatgtggtgcaggtgttgggggagtcggagttggtggcttggaggcacctatgagggtcctggtggagatgtggggctcggtagagggactgaagagatgcacggggactcaggctcacaggtgagaccccaggctgagggctggggtgcacaaggtggcagggtgcgactgggagcaaagcaaggggcgggtggcacatggccatcctccttgggccattgaggggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgtatgatctttccctaagtcttgctttttcagtaggatgtgctcatgtggcattgttttgatttgtcttgatgagctcagtgagcctctttaatccatgactcagtgttgggaaactgtcaccattctgtggatagttccctcttcaatcctgcaattgcttgctggatgtgtactggtgtttcccattctctcttccatgtcttttagcctagtcccgccatttaagtcttagttctctcttcaggtgtggcaggtctctgtgaacccacctgctggattactttcaaagagcactttccattttctaggtttctatttgtctgtacatcactacccagcctgtctcataactccgtggagtgtggggtgccctagaagagcctgtgatgggggctgttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgtctaaaaaaaaaaaagtagaaggcctctctactgagtgacagctgggccagtatgtccctccctagtcctggccctgcacatattcaggggtgtgcctagagccaactgggctgtgctgggcacatgctgtagtgcttgtttgtttttaaactgagcagcatgtgggcatgccaggagggaggagaagcgggccagcatgctgttggcatcctcccccagtggtgctggctcttaccggcactatttcctgagtcctcccactccatgtttgggcctagccacacagaacacctggcacagcgcagctctgggaaggctgtgtgtcctggcgaagacccactgcccttttggaccatgcccttgccgtttgcattcatgccctgcattcgtggtagttgacattctttcacaaaaagccatttgcctcagcgtccagggttagttggcttcttgtagggtggtgttgggtgtaccccaggccctcgcacccacaggttgattctcgaggtatctgtcattgccgtgtgttttccagaaggcctgctgcccatcttagattctgcctaagagacttttgcagctcaacaaagggggtgtggtggaggttttgacagataacttgcagtggggccttttgtgggggtggagatgccttgggcgtggctgtgtgctcttccctctgcgggatcacccgctttcctccctatgtgctggaacccacttcccttgcccagactcttggctgccctatagacagcttggctccatgtcttgccagcactgatagctctgtggggtctatggagccatcagcccttggctatggcaactccgaccccagtgggcatatccgtgccctgccctctagcagctccctctagcgtctctcagacctggctgcatctctccacccacgccagccactgctgctgccacctggtctaggtacctgcagtagcctgctctcaggcctccctgcatggtccagggcccgcaaagctgttttctcacgtgccaccgaagtggttccctaacatacagctccgagctcctccctgcctgctcccaggaccccagggtgagagcgcacacacccagtgtggcccgtgaggctttctggtagcctgccacacgtctgggcttttccttctgtcctctcctgaccctgtcactgaagtgctgtctctcctcagggccctcgctcagcctctgagctgtggggatgggaggcagcagtgcacagttcactctgcagggtggtgagaagagggcagtgcccaagcctcaccctcgggctcttttttttcatagcccgagctacactggaaatcctcatccctgactttgttaaacagacctctgaagagaagcccaaagacagtgaagaactcgaggtgagtgttgtggtcctgccctgctgggagctgtgtgtgcagtgcggctaccctgccctgttagtgtgagctgggggtgtccgtgggctgtgctcatgccttccatgccctgtaggttagtctcatccagcctccaggttcttctgtttgtatttcataaagaggaaacttgcctgtctttgtataggcagggaaaaaatgtcctttttgttagagatttttgtcctcttttgcagcattgagtgtgcaccgtaaatgtcgggtacacataggtttgtgatgggaatgaatctttgaggcagtctacaagatttagattgttcttttttttgagacaaagtcttgctctgtcacccaggcagtgacagagtttgatcttgacccactgcaactttcacctcccggattcaagtgattctcccacctcagcttcctgagtagctgggattacaggtgtgtgccaccatttctggctaatttttgtatttttagtagagatggggtttcaccatgttggccaggctggtctcgaactcctgacctcgggtgatccactcgcttccgcctcctaaagtgctgggattacaggcattagccactgcgcccggccctagattgttctttatatacttgacccttgagtaacgtggaagttaggggcaccagcctctcacgtggtcgaaaattcacgcatcactttcagtcctcccaaaccttaactacttactggtaacctactcttgaccagaagccgtaccagtaacaaacaattgattaatacatattttgttatgtacatattactacatctgtccccaacctagttttggcaccagagatcagtttcagggaagacaatttttccacagacggtgttggggggcggggatggtttcaggatgactcaagcacatcacatttattgtgcactttttatttctattatcactacactgtaatatgtaatgtaatcactatacaactcaccataatataaaaccagtgggagccctgagcttgttttcttgcaactagatggttccctctgatgacgatgggagacagtgacagatcatcaggcattagatttgcataaggagtacacaacctagatcccttgaatgcactgttcacaatagggttcacactcctatgagaatctaatgctactgctgatctgacaggagacagagctcaggtgtaaaatgagtgatggggagcagctgtaaatacagattaagcttcacttgctcacttactccccctgcccccaccactcatgtcctgctatgcagcccggttcctaacaggccatggattggtaccagtccatggcctgggggttggggacccctgatatatactgtattcttacattaaagtaagttacaaaaagaatgttattaagaaaatcataaggaagagaaaatttatttactgttcttgaaatggaaacatcatcatgaaggtcttcatcctccacatcttcatgtcgaatagctgaggaggagggggaagaagaagagttggccttggtatctcaggggtggcagaggcagaagaaaatttttgtataagtgggcccatggagttcaaatccatgttgttcaagggtcagccatgtgaagaaccatttaaaactagctgtaaacctttttgggtaaatggttatttgtagcaagggcttgtggaattttgaagggtgcattcttatttatataatagctttattgagatagtttacatactataaatttggccttttaaactatataagtggatttttatatattcagagttgtataaccatcataactacctaattttagagtatctcaacacccccaaaagaaactccatacccattagcattccctcttagttctctccaaccaccaaaagccactaatctgctttctgtctctatatatctgccaactctggacatttcatattagcggaatcatacaatatgtggtcttttgtgactggcttccttcacttagtgtgctatgtcagctgtaggtttttatcagaataaggaaatttccttttgttcctggtttgctgagagtttttgtaggaatgatgttagattttgtcaaatgtttttctgcttctattcagatgatcatgtttttttttgtcttttattttagtaatatagtgtattatattggtttttgaatggtgagccaaccttgcattcctgggatatatcccacttggtcatgacatataatgatttttttaatatgttgctggattcattttgctggtattttgttaaggatttttgcatttgtagttataagcaatattgatctgtagttttcttgtgatatctttgtccagtgtaacagcaggtacaggtatcaggataatactggcctcataaaatggttggaacatgttccattttcttctgttgtgtggaatagtttgtgaaggattggtgttcattttttaaatgttttgtagactgcgttcagtgaaaccttctggtcccaggcttttctttgtccagagctacttaattgctaattcaatcttacatgttataggtctattgagattatctatttcttcttgagccagtgttgatagtttgtgtcttttttggaatttttttcccatttgatgtagattatctaattgattagcatatatttgttcctagtatccccatatgacccttttttatttctatatggttgtgatggtcccttgctgtcattcctgatttcagtaatttgaggctttcttctttttcttgatcagtaaattgttacacttgatgatacatcacaggtctctgaggctctgttgtttcttctctgtacttttttctttctgttcctcagtgtggattatttcaattgccctgtcttcaagtttgctcctttatcttctgttggctcacattctgctggtaaacccctctagtgactgtttcataatttctgtcttttttaaaaaaattctttattgggtaatgcattgtttttatactttaattctttttttttttttttttaattatatatatagggtcaggcatggtggctcacacctgtaatcccagcactttgggaggccaaggcgggcagatcacaaggtcaagagatcgagaccatcctggccaacatggtgaaaccccgtctctactaaaaatacaaaaattagctgggtgtggtggtgggcacctgtaattgcagctacccgggaggctgaggcagaagaaccacttgaacccaggaggtggaggttgcagtgagctgatactgcgccactgtgctccagcctggtgacagagcgagactcctgtctcaaaaaaaaaaaaaggaaaaagaaaaaaaatatatatatatatggggtagagatggggtttcaccatattgctcaggctggtctcgaactcctaggctcaagcaatctgcccacctcagcctcccaaattgttgagatgacagacgtgccactgtgctggcattatacttcagttctttagacatggtttcttagtcctttgagtatgttttctgtaggtgatgtaaaatctgtttctggtaagtccagttctcagagagcgtgtatattaaactgcctttcccttcatgtatgggctgtctctactttcctatttctttgcatatctcagaattttttgttattgtcaagaattggacatttaaaatatatggcaactctggaaatcacattacctcacctcccttaagtttatagtttttgtcatatgtccttgctctctatttgtgactgtatcagtttgctagggatactgtaacaaagtgtcacagactgggaggcttaaatgacagagatgtatagtctcaaagttctggaagccagaagtccaaaatgaaggtgtcagaaggctaagagaaggcctttctccgtgggtggaggatagcgatctccatgtccatgcctttctctctgtgtgcatgctggtctccacattgcccatttgatagagacacctgtctcactggattaggccctaccctaatgacctcattgtaatgtgatgacctctgtaaagaccttgtctccaaatactgttgcattctgagggacttcaacatgtaaatttgggggtgacagtttacctcataatagtgactttcctagattgattctgtgaagtgtgtattctttatgatttgtggccactgaatacacgggccctttagctgagtggtctcctgatgcttggacagggattttcgtaaattccctgagccagtaagtctcccggcctgtgatgagagctgtgggtctgtggggctcacctggtgtgctccggtggctgccaactgtcttagcctttgtgtgccacctgcacagagtctccaggtcagtcagctgggaggttttcctgggcctgtgcgcagtcatctccagacatacgctagagcctttcagagccccatggacatctccagcttttccttcttgggttcttggccagcctcttgtttgcccaactagtgccccagcctctggcagctgcagggtgaaacagttgccactggttccttttgacaaaagccctcaggaactgggctgttttcactgagtgagatcaaataaagacaaatcctgccatgaggcttttccagagggtggccaggtaaacccaacagtgacagttctctgggcctggggccttgaggacccgttctccattgagtggctaccactgagctggggagaagggctgggaatggggcgagttaagatgccagcaactccttgttcttagcaagactcgttgtctttcttgaatcaacactcctcagattgttgaaagcctttctttagtttccagggttctgaaagaattaattctgaccatttttgctagtgttcttgttgctttaatggaggagagcagattttggaggtccttattcggccattccagaactactttaggatgggttttgtaaagttttctcatctttgtggactggtgctgttataaaatatggttaagtgtctatggtagtactaacttgctcttaagtttcttgaactcctggcttcaagcagtcctcctgcctcagcctcccaggatgatgggattacaggcgtgagccaccacacctagtctcttgctctcaagtttctacatgttttctgtgctttatgtaactgcttcatcgtggacaggctacagacagattgcagaccacatgtggatcaagcacagtctccaagtactagctgttccaggaagagtcacatttgtccctttttttttgagatggagtctcgctctgttgccaggctggagtgcagtggttcgatctctgcttactgcaacctccgcctcctgggttcaagcgattcttctgcctcagcctcctgagtagttgggactacaggtgcacgccaccacgcccggctaatttttgtatttttagtagagatggggtttcaccgtgttggccaggatggtctctatctcttgacctcgtgatccgtccgtcttggcctcccaaagtgctgggattataggcgtgagccactgcacctggccacatttgattttatttctgagtgacccaaccgtgggaaatatggctcccagggaggcttccaaggccctctggggaagtgcttgcgtagaccctggcccaccaaaactcttagtatgggttgctgcagacgatggtgcctgagttgtgtaggtctcacgctgccttcctgtctgagtaaaagccctgcctgttctttgctatggggtggtggaaatgtccatgaaccactgtggtttctggtgccaggagagggcccagcggggagtcaggttctcagcctccactctggggttcttctgtgaagtggagaggctttgcagaaaccacattgcaaagtagtctgagaaagaagaggtttccccaggtggagaaggacatgggggtggggcatgtggtggcttccgctgtagactcccctgcctggggctttttccacacccctactccgatcctcccacactgcagcctgtctggagctagcgtcatatctccccaggtaaggagctcagtttcgtgggactgcccccacttcctgtgccagccgcaaatgggggcccctgccacccggcacaggacccctcctcgtgcttggaaatttgctaggactcaggaactcaggaaaaattttacttatgaaacttatttttcatgaagggctgaaagttcctcccctctactgacacatttgatttctccggggagcccaccctggccacctcctcagcataagctctgtggtggggtcgttttgaatcacaaaagacaaacctagcactcaggaaatcctcagggttttaagaactctgttctgggaacctgagagaagaccgtgtgtttttatgatgccatgccttggtttagggtgccttttgtatgtgcccctcctgagaagctctttgaccctcttatttgtatatatgtcatctgtgggctgggcgcggtggctcacgcctgtaatcccagcactttgggaggccgaggcgggcagattacgaggtaaggacatcgagaccatcctggctaacacggtgaaaccccgtctctactaaaaacatacaaaaaattagccgggcatggtggtgggcgcctgcagtcccagctactcgggaggctgaggcaggagaatggcgtgaacccaggaggcggagcttgcagcgagctgagattgcgccactgcactccagcctgggcgacggagcgagaatatgtctcaaaaaaaaaaaaatgtatatatgtcatctgtgatgtccccatttaaaaatctgtcagaggggaaagtagcttttccctccgttgtagggtggtgggggtgtttagacaggggtggccatctcctgttcctgggaagtttctatttgctggtcctccctagcgaggctctcaggttgtgtccccgccccctgctcctcccagctgcctgtgcagaggtgccaacacctgtccttggactgtcccctggacagcctggggcgtggggtagtatcccctccttgtgtggactccggaggtggggttgacatgtcaggaggggcgggttgatgcctgtgaggtgtggtggccacgcgtgtatgctacttgattaaaaagggaaaaaaggaacaactggcatcatttccttttcacaaagcttgtggtgatctcttggtattttgttgctagctgtgggttggtggttcatggctattaaatttaggtattagtgaccaagtgttttcttttttttttttcatcttattttaaaatttacatagagttaaattcactttttggtacagtactgtgagttttgacaaatacacagtcatgtaaccaacactgcaatcaagatgcagaacatttctgtacattccaacattcttctttgttggtcaaactctcccacctgtatcctctggtgggcactgaactgcccctgtagttttgccagatcctgaatgtcctcttagtggagtcacctggtacgtagcctttgaacctggcctctggcttggtgtggtgtgacgcatccgtcgtgtggtcatttgtactcctgagtgctggccaccaggtggctgtgcccctcagtgcgtctctccattcttccttgagggacactgacaggtttctgggttttggtgatgggcagtaaggctgctgtaaggtcgtccaggtctgtgtgtgatgggcggattcgtttccttcaggtaaacccttgggatggggttgctgggctgtgtggcaggtgcacgcttatgttagcattgccctcacacctttctcagtcactaggtgaccgtggaagtgtgtctgttttggggctgtctactgtctttcgagctgtgtgtccttttcctgatgccacactttcctgatgacttgaagtcttgatactgggagtcctccaacttcgttattctttctcaaaaaattgttttggctattctagctcctttgctgttccatgtagactttagaaacaatatgtcagtttctataaaaaattctgggctgggtgcagtggctcacgcctgtaatcccagcactttgggaggccgaggtgggtggattacctgaggttaggagttcgagacctgcctggccaacatggtgaaaccccatctctacttaaatacaaaaattaggtgggcgtggtggcgggcacatgtaatcccagctactcaggaggctgaggcaggagaatcgcttgaacccaggaggcggaaggtgaggtggcagtgagccgagattgtgccattgcactccagcctgggcaacaagagcgaaaccccatcttaaaaaaaaaaaaaaaatctgcctgcattttgattggaattgatcctgtagatcaatctggggagaatggacatcctaacaatattggattttccaaatcataaacatagttcatctgttcatttatttaggtcttctttgatatctttcatgggtggtcggcagttttcatcacacaggccctgtgtatattctactagatttatagttaaatattttatgtatggcactgtgatgaatagtaccttagttccaattgattgtttattgctagcttacagagctagaatttgttttatttgcactgatttattctagtagtttttctgtagattccttatccagttttcttctctaatttgttaatgtagttaattacgttgtttttttaaaaatgtgttcctgggataagtcctacttgggcatggtatatgttccttttcatgtgttaatggctttaatttgctagttccctgctgcatctgtgttcttggtgttaaggtcatggtacgggtagtgtcatcaagcgaagtgggaagtagccctcctcctgagtttttcagaagggcaggacagatataggattggtatcatttcttccttaaaatttgggcctggagttttcctaatgggaaagttttaaactactactgtatgaactactaactataactatgactactctgaactactgttgagtttcttgaacaggtgtagggctgttgaggctactgagatagtttgtgtcttgccaggcattggtccatctcatatagatagtggaatgtagaggtgtcgggcgtctgtggtgctcccacacggtcctttggcatctgccaggcactgattgcttaggtttctcctgtgctgtttgtcagaagcaacagggatttgtctgcaggtcacttctgccatctgtctgctctcatgagctggagcctccacctgtccctggcgggttaaccctcagtagcacatgtggcctcaggcagcttggtgcagggcatcctggtgtcggtcttttttttttttttttttgagacggagtctcgctctgtcgcccaggccggactgcggactgcagtggcgcaatcttggctcactgcaagctctgcttcccgggttcacgccattctcctgcctcagcctcccgagtagctgggactacaggcgcctgccaccgcgcccggctaatttttttttgtatttttagtagagacggggtttcaccttgttagccaggatggtctcgatctcctgacctcgtgatccacccgcctcggcctcccaaagtgctgggattacaggcgtgagccaccgcgcccggctggcgtcggtcttttgccagaaacttctgagcgtgctctctagctgtgtgtgtgtcagccactgcctcagcttctccagggccagtcccgaagccgtggggtatgtgggttcttgtgggccgacagcactggacgttgctaattggttggctggttgacaaacccttgaggttccagggcctgatgtcttggtgagtgaccttccctggaaaaagacccatgttgatttgtgcacttgagaggagcagtgtcttctggggacctatttgaagacagtagccaagccatacctcgaggatttttcgcttgccaacctcagggctagtgccttcctcttctatgcagttgcagcgagttggccttgctgcttgctggagcggcgagggcagaggagctgcccactgccctgtctgtagggccagtgtccctgtggagcgggcttggcacactgtggagcctgcacagcgaggcgtgtgaatcatttgattctaggtttcctcgctgcccatgggccaggcaggctccaggtccctgcagacccctccagaacagggccagtgggggaagcactgtgagggtgtggctgatgggtaatctccagtgcttcaaagtgtggtcttttttggaaagaggatgattgcagatagaattaggttaacatgagatcacactgaagcagagcagtggtgtgatccagtgtgtctggtgtttctctaagaagagggaggaggggcagggctagtagtccatatgaaaatcggagcaatgctgccatagccaagggatgccggggccaccaggagctggcagaggctccctagaggcttctgaaagaggatggccctgctgaggccttgatttcagacttcagaatggtgagagaataaacctcttgttctaagccactgactttgtggtatgttgtcacaggagctccaccagggaggttgtccatgctccagagtgggctggatagcatcttcctttcacccaggaggcactctcagcttcagccaaagtcctagtctgggaaggcacagtgggcaatgtctctgcacctcagcctgctgcagcttccctatgcctcactgtgtggaatctccccatcacctcttgtttccctgtctgcctctcttgtccttcctgtgtgttcttgggttggctgcagagccagggtgatgacactgttggaagccttgctgggctgggcctctgctggccacctggggctgggctctgtgtagctgtgtggggctttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttggcgggagggaggctctcggctgcgtggctttgagtggtagtgtcctcagctcctagactctgagggccactctctcaaggtggcagctgggtactgtgagactcaggtgcccagagcagtggcagagtgctgcctattcctgtagaatgtgccctggctggccctcggggtgtgggtcaggagggctgggagcggcagggggccccatgagcactgggtgtttgtgaccccctctccatgcttgctctttctctgtgtaggtaagaacaagagagttggaaagcagttagcctcacagaagatccttcagctgctgcacccacatgtcaagaactgggggtctttactgcgcatgtatggccgtgagagcagcaagatggtcaagcaggtaactggccatcagcaggtcccagggcagcctgtgctgccaccctggagcgtattcctgaggctctgtgctcagagggggcagagctgggcagctctgctgttgctcacagctgcctctctcctgggccacttgtgtggctttgtgggcaggggtggggtcgtcccagctacatctcctatcccagcctgctgggcatggtcagtgaagtgtgggtgattgggaacgcaggctgggcccagctatgtggcttgtagggagatggccaaagtgcaaggcagggccaggcaggagatgctgaaggtgcgcccggctcggaggtgtgcaaaggctcaggagccagggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtggaccatgaaggtcacagtcttggtgggccacctgagtcccatgtcctccctgggtgtttggaggtaggtcagtgcacctgccagggttgaatctgtagggcttggtcctgatgaagcctcctaaagccaccttgggaaccccactcaaagaggggcctgtcaggctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagttgcccatggctgcccgggggttgcatgagacgtacagcagccgcctgaggttcttagctctccggatggccaggatcaccttggaatctgaggaggcaaacaccagctgggtccccacagccagagagtgcataacatggtgagccaccccatgtgtcctcgttcccgtgccacctccttaagcaaaagccactcacgcaagccagcacggggtgggtccaggatggccacgaggtgctgggaggccagtctgctcaccagggtgggcaccaggtcctcggccctcccgcagtggaactccacattactcaactctgaagagatggcaccgtggcctgtcagagggccacatgccctcccagcagggccagccctggggaacccctagccaaagagcttgctcacttgctctacctgtcgggcagcccccaagccctggctgtggctgaggcttgcagcaggggtggcggctgcccccatccccacccccacccacggccttgccactcaccattgtcctgggcgttcacccgggcgtcctccacagcctctgggcatagctcgaccccaatgaccctctttaccttctgaaacaggaaagcgtggtgtcgccccacccagggaggggagtacatggggccctgtgggcagcaaagaggagctgggcctggggcatgatggagtcagctgtggtgactttgagctggggtcaatgggggtcttggggtggggagagggtgccctcagcagggcaggagggctcacccgggccagggccaggccaatggtgccggtgccacagcacacgtccagcaccatgctccccgcatccaattgggcccagtcctggatgactgtgtagagcacctcggctgcgggtgtgttcacctgggggcaggcggtgcccaggatgtcagtggctcctctcctgtggtgccactggtgccccgacgcccacattcctggtccctccatcctgccgggacctccggcgcccactccccaccttggtgcccaacgtcttccctgaccccaccttggaccagccttgctgatgccctcatccagcccctggctttaaaagccaagcccgtgctaagcacagcctcctccttgccccacttggttgagggctcatgaggccccgcaggccaataggctgtaccttccctgccccagcaagggggctttgcctcccacaactcacaccggggcccctggaatcacccaactgcagctcccacccccacacctagccctccaggaggtcctgccaggcctgtctccaaaaacggccgctccaggtccccacagccttcctgcagcagtgagcaaacagtgaaacagtatttcccagcccagaggccaccatggcctccctcctgccgagcccagagcagtgccctgtggtaatgcactgagggccactcctcatcctccctgtgacaagggccactgccgtgtgtacctctaggttatcccgagtcaaatcagtgatgaccaacctctttcttacttcaccctcccctgtggctcacctgcctggatactcccccaaatctcaccgcctgagcccactgttcccatcacgtcctgatggtgcgtcaggcctccctcaacatgtccccatgcccaccagggactcatggctacctggaagaaggcgtgtggagagatccggaaggtcagccctagcaggtcctcgtggatgcaccggtccccagccacatgctccaggggcaggccctcctggctaggagtctttctgtgggcgaaggtgcaggtccttcagtgtcacagtccctgcagggacctgccccgccccactcgggctccttaccgctgtccctcctccacgaagtagaggcaggtcactccactggccctgcctggccctgctgtgaagtgctgcgctagggaggtcttcagctctgccagctcctcagggctcagcttctggagtaagtggtgaaaagttcccatcaggctgtgctgaggcccacctaggctaggcaccctcccccagcagggcccccgttgagacctgggggtggaagtaggcaatggccatggcctggtggcggcggctggtgcgcacagtcagctgcttccagtggcctgtgtacgtctctgggtcgtatgccgagtatggagtggacctgtgggaatcacgagctggcccaagtgcccacaactgggcaagcagtccccctgctctctcctctggccacaccttccttcatctggctgaaatggcaggcactccagaattcccggggcaggatcaccaccctctgctcccacaccgcataggacttcccgggagccccgtcacaggtcctcaccggatgaactcctggaaggccttcaccacctgcttggtggcttcggggatgtgcacggtgtcaaacggggctgccacagcacacgtcccgcccttgtacttgccgagccgacagcccacggtgttatcctccccatccaccccgacgccaaccagaaactcacacttattacgatactcagtctgcagggagagagagctgcaccttaccctggctgcccagcgcttgggcctggaaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaacgtcatcgtcacgcgccggatccaacccccaaccactttagccagctctagaggcgcgcgtggccgggacggaagtgcgcgcgggtgtcgccgggagtgcgcgctcctctggctgacgggcgggccgggcatgcgccgcgggcgttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaaggctgactttggcccctgtggcagagtggcccctgtggagggaaaggccagtctggtgtgctgggggtgggggctcggccctgtagctcttcttttggaaagcctattgtaccctggccttggagaaaactggggtcttggcctcctggacttgaagtccacacttggcagtgttggagttatgggcatctgcagtaactttaaataaggagatattttccagtacgccattgggggttgtcatgtgtaatggattgtctctgcaaataccatcttaagtgtgtggtcccaactgccataacgtgccctgtcaccgtttgtcatgaacacctaccagacgtgcttactgtgaggctggctgcctgctgccatcacttgctctttcgtgccctccacctgggcctgggccctgttctctctgacctccgtgtgctgtgtcctgtctggtgactgcctgctggtttaaacaccagtcctttgtctctctggggcaggggtccccaatccctggcctgccgaccggtacaagtctggcctgttaagaactgggcaacacagcaggaggtgagtggtgggcgagcgagctttaccacctgagcgcctcccctcagataagcagggcattagattcctataggagtgcgaacgctaacgtgaactacgcatgtgaggaatccgtgttgtgcactccttatgagaacctagtgcctgatgatctggggtggacagtttcatcctgaaaccactcccccacccctggtccatggaaaaattgttttccaccaaactgatccttggtgccaaaagggttggggactgctgctctgggggatgtacttccaaagtcaactactctcaggtttgtttatttttacataaatgggaaccactttatggtctctagcatcagccaaggctgactttggtgggtccctgtggcagagtggcccctgcagaggaaaaggccagctcaggagagaaggctgtgccgactcctcatggtttccagtgccctacatgttcagagaaacgtctttggtaatgaactatggaaatggtccctgaaggtatggtctttgctctagaaaaagcccaactgatgactcctcactggcatcttgactgtgttctgtgagctgtggccctcatgctcatggactgcttgcctccagcaggttggcagggggacagtggtgcactttgcacccaagaagaggtgaagcctgtgccctatgccctgtgccgagtgaggtcctcgtgttgggagggtgacgccgtccactgcagatggtgccttgctgtgctgcactcttggtgacacccggggccccaggtcgggtacaggtgtcagttggaggctttgatgtctgtgaaagggagggccccttgcactggctggagcttccaggagagaagcccttggctaggacaggcaccccccagcacagaaaggatgtttagcattctgtatttgatttggggttccaataaaattccaggctgacttccttcatctggggatgggagaaatgtctccaagggagagtccccagcagtgagaaggcccctcggaatggctgggagacagtgccatcctgtggtggggctgtgttgcagggtgcatttgaggatgcagcttgttgacactgcaggatgcgatggtgctgcgggaagggagctgtgctgggagacagaatgcgtccgcgtgctggccccacgggaccacagggtaggctatacaaggacgcccatgtgggcactcgggccagccgtccagcccagtgtgtttccattggcttccctttggcagacaatggtgagcagaatggggtcctgccggtgctggggactgtgtgagaatgcagtgtgcttcagccttccatcccatgtctgtctgccgggctgcaggctggggagcctcctgctttctgcttcattttccttttccctgggatcttagctcttcttgaggaggaaactaggccatgggcttggcagccatgttgggtggggaggccggtgccaacctcgcttggttctctgtctccagtagtgggtctgcactacttgggacccctctgcccaggcctctgtgttaaggaaaagggatcccaaggccagatgcaatggttgacacctgtcaccccagcactttgggaggcaaacgtgggaggatcacttcaggccaggagttcaaggccagcttgggcaacatagtgagagaccctatctctacaaaaaaatataaaaaaaatagcctggcatggtggtgcacgtctgtggtcccagctacttgggaagctgaggcaggaggatcacttgaaccctggaggttgaggcttcagtgagccatgattgcaccactgcactccagcctgggtggcagagtgaaaccctgtgttaaaaactcaagggaaaagggatctcaccaagtaggcctgattccgcttcttcccactgtcagcatttggcagtttactccagggttcagctggtggaggaaggtgacagtcctggcaccctgcacagagcatgggcatggagtcagacctggatcctgaggggctctgtggcatgtgccactagaggaggcacttcatgggggaaggtaggagcaagggcaaggctggagatgggcaccaggtggcaggtgtgttgccaactgagaggctcacttgtggccactgcagagcccaggtaacgagccatctgctccagtggtgtctgctctaggctcaccattgtgccctgagacccctccactgcctcagagctaccatcagtgcttgggagcgctccaggctgcacctcctggagcagggcaccctgagaacagagcttaccactacggctgcctgggagaaagcccatcaccatttctgctgtgcagtagttagttgcattaagggctgggtcccggccccagtcctgggttcctccttccaatagccacaaccctggcctgcccaccctgaggagctgcggccgggtgcttccccaggggagcaggggcctgcaggccaaggagcctcatgcctgtgccgcagggtagggccgctcggggttctggttgcagaggagcagacactcagggctgggggcgatgggtgaggtccccccacagatctccacctagggaggggtctaatgggtctgggcttcagaacaggggacgctcggggcatgttggcgtggccgaggacaatgaccctcactggggacgctccggagcttgactgagggtctcccgctggcaccgcctcctctgccggcgtgtgtgtgtctgggggggggacccacacgaggccccgccccaccccgcccacagcgccgtcggccccggcccggtccaccttaagcggcggcggggcgggtgggatttcctgcgggaggagacgcgccgggcctatcgggcagggccggggcgccgggcttcccaaagggccccgcctcggggaggatgggggctccagccgaccgtctctcaagcctgcagctcgggccaggacgtggagggcccggcgcccgctggccgggctcctccagcccagtggcccgagggagggctgcgaggcggtcagaaggcaaacagccacgacgccgctgcggtgtcacacccgcgccccctcgtgaattccaaggggcttcagaccagaggggtcgttagggaaagggctgcgcccacagacgcccccgaggccacctgcacggctccgcggcccgggaccaggggggcctggccttcgccgtggtgcccaccacccgggccgcaggggtgcgtgggtgcccggcccccgagagccgcgggcgcccgccgggctggggtccccgaggccgcggggtcctgccccctccgaaggtcccgcgaaccggtggcggtccccgggccccatcaactcgccccgcccggtcccgccccgccgcggcccccagcgcccggtccaccttaaggggcgcgctgacataagagcgcagcagccgccgccgcccgtggggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgagtcggcgccgcgtctgggggcacgcgggcagcgatgggcagggcccgcacagcccgggcacgggggcagcggtcgcgggggctggcggggccccgggcagtgggcgggcggggcgccggctgcaggcgatggcagtccctctccacccgctggggctgggggagttgaagcggtgtgccggcgtcccgggcaccggggtgagtcccttgtgtggggacaccagtgcgggctgggcacctcgggagtgtccaggcaggccctggcggggagcgctgggccctggcaggggaggaggccgggctgccctgggtgtggctgcagcccttccctccccatgggacccccgaggggacgtgggccacccacaaccatgagtcttctctgcaggtggccgtgggtgcctctcgggtctcctcctggctgcccgccccgggccagagtcaagttgttcccacgtaggtgtggcctggcctcgttgccacgtgcctgccccacagccactggtgacccgggcctggcccttggcctccttctcaggaagacccagtggtcatcacagctggagggcccaggccaggccacacccagggcccgatgttagcacatcacctccgtgggctggccatggtgcacaccaggacccttgaggtcctgtttctgggagtgagagcccgcgcctgcaggacactgggcccctccagcctcaacttcttcacccaagatacaggctggcttaggaccagagaggcatgcggacagcacagcctccctctgtggctgtggggtcaccccagggctccttcaggcacaaggagggttgggggctccaggcttcggttgcacagatcttcaaccacccaccccccttccaccaatctggggttgagacatagcccaggtggcacgaacgatggccacctgttccaaggtggggccacccctgagcatgtgagcctggagaggggcaggtaggggctgcctggcgctcgtcacctttgcaagagtttggggggcccccacgtgcatcgcaaggctgaatcgggtgcccgtggaggcgagagagttacctgcaggctggggctgggtgggcaccgcaggctgccaagagcatgtttaaaaaaggcctgtgtggacgggcttatttctggctcgggcaagccagtgtgttcttgtcacttagttgctgctggtgtggggcagagagaggtgggtggggggcagcctggggagcctggcctggggggacacatcccaccaaggcttctggaggggtgggcccagcccagtgctggtccccagggcctctgtccttgggcggggggtctggcttggttccttactctgtccatgcaattcagtgtcctttctcatgactttaaaagtaatgtgtgggccgggcgcggtggctcatgcctgtaatcccagcactttgggaggccaaggtgggcagatcacctgaggtcaggagtttgagaccagcctggccaacatggcgaaaccccgtctctactaaaagtacaaaaactagccaggcgtggtggtgggcacctgtaatcccagctacacaggagactgaagcaggaaaatcacttgaacccgtaaggcggagtgagccgaaatcgcaccactgcactccagcctgggtgacagagcaagactctgtctcaaaaaaaaaaaaaaaaaaagtatgttctttatggggaacttgtgaaatacagaaaaaaaaaatgctaagaaattaaaatcaaccccacacaccccccatctcctgtcctccttggagggctcctctgttcctggcgccgcgtctgcagcctggctgtgtggtggctgcagctgctggttccctcacgcgtgatgtcagagggccctttacgtgactctgactgtgaacctgacccagccctaggcatggagtgcttgggtggctcccactctgctgagcaccagtttcccctcctctgttctggggttctggtttcggcgacaccagcagtcttgaggtatggggttccctcctggggcagtgcaggccatgcctgcacccaaccctacacctggcctatgctgacctctgccggccctgctcctgggagaagatgccatgtgtccctgtagcaggatggtggcctgggtgctcacctgggtttgatgtgcagtggccacctagcaaggctaagaagccctgcttgccccctcagggcaggtgaggccacacccctgggctgaatggctgtcagtgatcctggcctcttccccgacccgccccgcctctgctgaactcctccgagactgctcagttcctgagaaggggttctgttgggtcggctggcccattgatgccacccatagcagctgtgctgattctgggtaggcaggggtccaggcggcccccttcttggggcaggccacttgtctacccgttgccccacctcctgccctgtatctggtccaggcacacaggaaggggagcaggttgctcttgtgccccgaatccctgcccttagtgcctatacagggttcccgacttcactgtttgctcctcggacgttaccagacagtgagtggccccagccccctctctgcactcagtaaacatgagttgctgccggtggggtggcttcacccatgcaccaggtgggcaggagttctgggtgtcatgtggtgtggggagctggaggcctgagaaccagggacccctccctcagccagatcgccaagggtcttgggaccagcaggacattcacacatctctctaggagggtctgggcatggaaggatgcccagttgtgaagagcaccctctcaggatggggcacatacagcagggcagtttctcagaggccctcttccttcaggaagccttcctaggattttgttgttgtttgtttgtttgagacagggtctcactctgtcacccaggccagagtgcagtggtgctacctcggctcactgcagtctcgacctcctgggcgcaagtgatcatcccacctcagcctcctgagtacctgggatgacaggtgggcaccctcacacctggctaatttatttattttttgtttttttgtttttttttagtagagatggggtctcgctatgttgcccaggctattctcctgagctcaggtgatctgccagccttagcctcccaaagtgctgggattacatgtgtgatcactgctcccggccccttcctatgtttctgggggttttgtatccccctgggcttcagaagccctttataccatggtataatgctaggctgggtcagctgctggcagagggttcgaagacccctaggccaggctcccgaccctgccctgacttcactccagagccacattgcagaatgacagggaccctgtgaatgtccgagggctggggctgcctggcaggctgccagtgcctggggctgagccaggctggcttatctctgtctggggcatctgggatggtgtggctggtccctagatcgtcctgagccctctccttgcctggaggcccagctcaggacagcagtcagaacaggccctgggccagactagccttggtgggccaggagggactgaactgctgactgggacctcatgagtctggggaacctgggagtgaaaactcagtgtgagcccccctgctgggacccaccgcatgtggcctggggtattcctggcccccgagcctcagtttccccatctgtccaggtgtctatagggattggacaggtaggtgcaggtacttcgaggcccaaaggcctggcctgacaagggcgcagcagcttctgccccgccggtcccgagcgccccacgggcgagtgccactcatacacaaacagtgctaatgaagaacctgatttaaatgaaaacgtctgagttaaaattttccattccacatttagctgtggcggacattctgcccctaagccacccctcttgctcggcggtatctccctgccagcccaggcgggacttggggcctcagcccgggtggggcctatggtggtggtgcatgtccctgcctgtggccctggaggagggattggaacctcggggctgggccccctggacctgccctccacccgtagcttggctggagccagccaggaggggctcagagggacatggcgggccagacactccacctccagcccaggcccagagcctgtctttgcctggccctccggcaggcgagcctggtgtgcaccatcaggtctgggtgggagtggagcctccccgagcctggacccagactactgcctgctaggccctgcctgtgggaatgcgtgtctttgagtgtccctgagcatccacacatggcctcccctgtccccatgtgtcctcatgcatccttgcatgtccttgtgtgtcctcccgtgttcttgcgcaccctgagagtgcttgtgtgtcctcacacttgccctatccacagaggggcaaagggaagcccagagagtgggagggccgtgtctgaggcccagagtgaggggcagccgagccgaggctggatagggctgggtgcagtgtgaggaggcatgtgtctatgcatgcctgtgttcacgcgtgttcacacataggtcttggtgggtgagtgatgtgcaggcgtgtctgcgttcatgcatgtgcaccagtgtgtgcacgtgtgcatgtctgcatgcaagtgttcatgcatgtatatgtgttttgtatgcagacatgattgcatgtgtgcatgtgtgccttctgtgcaccagaacaggttgtctgtgtgtttatgtgtgtacatgcctgtatatttgtgtgtgtgcacacatacccatgcacatgtgccctggagcatgtttgtgtgtgtgtccatgtcttcacacgtgtctgtaggtgcctgcgtgtgctcctcatcttctctcccactgagccctgagagctctgggccctggtgggttggcctgtgagctggtccctgttaggcaggatctgaccttggggactacagagaggacagttgcctcactctggaggactggaggagtgggcagcagctcaggtcccagtcagagaacccacaacaagcctccccaacccctggattagggcccatatgggccctcacaggcatgtggcaggtacccgcactgggcaggagggacccggtcacactgcagatttcccaaagtagccccacggctgcaaggctgctgtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcccgcagtttcattttgcacagactatgtagccagccttccccagaaggctcgtggagagctccacaggccctgcctctccctgggggagctgctcacctgcctgtgcccatcttgttgggccgaccctgccttaggggcctgtggtcctggctgaatggcgttgcattggaggccaggcacatgtttgagtgctgcctgtgtgccaggcagggctggggagggtggaaggaagcctgggggctgagccactgggcagggacagggagagccctcccagcagagggaggtgtggccgcagctgtgtcctcaccctggtgtctacctccacgggctgggccctggacaagaggaagggtaacttgggctcccagccccgccgaggatggctgtcgtgggaagcggagtctttaaatagcctcttgctttccactaaaaatagtgaagctctgctgccgtggaggtggttgccggggcggcggggctggctcttggccaggcgggcgtgggtgcagcagcgtggccacgtgcgctggagtggtaggcagcgcgtgggccccatccactgctagtggccatagaggtcagggctgctgtgggggatccccactagccccccgactatgcagagggcctgggtgcagggagggacgcaaacccctgtgttcctgtccctgctgcttgtcacagcagctgtctcagggtgcgcaggggagagacaaggagcctgaggccagaggggcttcttggaagctgagtgggtggatttaggaacccgctgcaggccgtgtggcccgaggaccggcaagtctcttcagaggggactcgggccaggcccgttaagggctgaggaaggcgcctttcaggaaggtgtgtgagggcacaccttatagggaagctgcagagggcagcctggagtcctggaaagcttcccggaagagggggtggccttggagccaagtgctgatggctgggaagatgggaagtggtggggggtgttgtgcattctagagtccctaagtgttctactttgtcatctggggagggaggtgacaaactaaaaagaaggggctgtctggatggggatgtgcctgactgggaagagtaggggagacatgccccatgcacttactgaccaaggactggggctccccacaccccagaatctgcctggtgagaggccccactgggccagggacaggcctggatgaggcatcgtggcgcattttccatctggggctcccacctccagcctgtgtaccgcccccgccccctaccccgccccagtcatggagcctaggtcgctggaatggggtgaccttaggtctgtgggcctctctgagacggctgccctgagaggttgccgggtcagggcacgggtagcccacatgctgtactgatacgcacagcctctggccgttactcgaaggagcgatgtggctgaggtttcttggcagggctgtggcagcctccccactgcctctgagctctgagggtgaccttgcaggcccagcctgccgcaccacatagctctgcgcctgcatccgctctgcacccccagactccactctctgcccccactgtctactgcaggtgcccgtggttgacacgagctgtgtccccagctgttcccgtctacaatggcatcatcttcctctttgtcctggccaacttcagcatggccactttcatggaccctggtgttttcccccgaggtagggccctgtgctgcggcagctcctctcactttcactagagtgtgagtggctaacttgagacagccttagggattcctggtgggtgggctggacttgggggagggattcacctgccaggaaagtcaacttcctgctcactgcctggctcctggtctgtagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgaccgccctgctgccccgcgctcccccagccctgtgccacatccctgcctgccatgtgccctgatgcactgctcccgcccaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcacgtatccttggttcctgtgggcctcattgcagaggcgatgtggaccggggacacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatcagctctgtctaccaatgtggtcccctggaccggacagggccctgggttggggaggtgacaggacctgggcagggagggtggtggccaggaagggaggggagttgcatgaggggcatgaggtcagtggatcagcaggttcagcgctgaaaacctgacctctgaggtccctgggagggcctggcccagggggcaagacctgaggaccccccagtccttactgctgttgcctttcagtggagaccctcctaagacgccttggggggtcagagccccgtgcagaggggctgccttctggagggcaggtaggatgtggggtgggaagccggccctgagctggggtctccaccctgagggaccctcgctgcaggatcgcctgggcatccctcccccaatttccacagagacgtgctcaccggccacttatgtcatgattctatgtccagccacaggcccagccctcaggacagaccccacctccacccttctctgcagcttctggcaaggatggtgcacagtggtgccatgtgcagggggctggcacggccactgggcatccggggcagtgctggtcgcctggcctccttgctggggccgctgggcctctggcctagaagggcaggaagccgtccactttgaggcgcaggaaggggtccagcagggcccggagcttccagacggtggcacggctcagcaggggtggcaccagcccctcgaaaggtgtggggttcaccacgtacacgtaggcagcggtccagaccagcagggcgcccagcagcagcctcagggtcagcagcctgcgggcggcggtggtcaggggcaggggcgcgcggggggcctgggggctgggctctgccgtgcagtcacctaccagagctggcctgccaggcccttggagcttcccagctttggcctccctttctgtcggggaggggctggatcagagcccaccccgagtgtccaggctgagggcagggatccctggctttgggaaaccctcctcagacagggctccccgcaccgcagccctggccccttcctcctggacaggctcctgcagccacttttccgatgccccctgccctggacctgccctcctggagcccatttctccctctcgcccaagcagggccctgggtggggggctggtctccagacccagagtggggcgtggggggctcaccgacatgcttgccatctgcttctccttcctggctcgagtgcggcactgggcccgctccctgcgggggcctcactgtcaggaccccacaccctccacccccagcctggcacccaccccctggctcggtgctgtggaggtggggggtcaaggatgggtctgccctgtcctgaccaggacaccttctgagaccctgctcagctggcccggcccctgcccccgtgttacctgagaatctccagctggatgtcctccatctggtccagcacgccccggatgtccttcttgaggttctgggggccagaggaggtaagcacagcaggcccctcgccccgccctccgtggcctctcgcccgccgggccccgtccttctgggtgctgccctgtggggacctaccaggagcccggtggcctggttgttcagggccatgtgcatctcagccacgttgtcccacacctagggggaggtggggtcacgcctgaggagcaggacccactgggtgggcccccagcacccctccccctcagccaggcgggcacctctgtgatgaccatcttcttcctctcaaagcacaggcggatctgctgcagctcgttctgagggtggggcccaggatgggcttgggcagcatcagcagggtggccagtacctccccgctgggcccactggcctactgcacgaagacctccctccctaatgaatccctcaggcccacctggagtgctgttacgaagcttcctccccccccacagcccctcccccaggcccacctgggactgttgcacgaaagcctcttgcccctggcacagctcccgccgcagcagctgcagaggtgccctgttccccaagggctgcgtgccagccgggtcggggggctgtgggagagcccccagatcagccctaagactgcgggctagaggggcgttggctgcatggggtccctgggccctgtatttacccaggccagagcagtgcagcttgagtgttcgggacacaggggcaggaactgctgccccggccccaggagggcccccagctgctcccgaagttcctgattctgccttttctggggtggggggcagagagagggggctgcctgtcatggccgctcctgcggctggggctggggcaggggcaggggcgccaggtggtgggtggggctggggctggggcaggggcaggggcaggggcgccaggtggtgggtggggctggggctggggcaggggtaccaggcggtgggtggggctggggctggggctggggcggtgggtggggtgctcaccaggctgtggttctcctgctccagctgcaggaaggactgttctgcagagcccagcagcccgcactgaagctgggacagggctaccctgggcgaggccagggcccctccctcccgtgacaggggtgggcatgggcagggtctggtccctgagccaatggatcccccctgcctgggagccccctggttcgaccctgggtgcaggggccagccccacccaagccctgcctccaggtctccttgtctcggcccctcagtgtctctcgctctctgctcctggctggacagaaagagcccgggagcctcgccctccactgtgggcccactgccccctgcccctgggactgggaaaggtctctgggactgcactgagtgagcagaggagatggggcccaggcagggccaccctacaaatccctggcagggctggtccaggcctcctccatggctgctggaggctggggttgggggacactgggggtgggggtggccgcaggggcccagggttttcagcccctccatccctccctgcaaccccttcctgatcccaggtccaggctctggcctggcccaacctgccaccctcttactgagggggctgccccaggcaacagtcacaaaggcctgggtgcagccagggcggtcacaatgggcccctcccacctggtcctgaagctgccccgcctgatgacctcactgcctctgacccactgacccaccatgcgagttttctttctttctttcttttatgggaaggggacttgctctgtcacccaggctggagtgcagtggcacaaggtgtctcattgcagcctccaactcctgggctcaggcaatcctcccacctcagcctcccaagtagctaggactacagatgtgtgcaaccatgcccggctaatttttaagttttttgtagagataagggtctcgctatgttgcccaggctggtcacaaactcctggcctcaagcgatcctcttacctcaatatctgaaagtgttgggattacggatgtgagccactgcacccagcctagttataaaacagataatacacacactcacagtgtggattcaaaaagtatcaaacaataaaaatggtgtccaagcttttcccacctttatctcctgtccctgcagacaggagcttcctctttaagctcctagaggtgggctgccgtcccctgcccctggttcacacagaagaggtcatcctgtagcccagctttgcttttcacctaatatatctctgaggttttaaaacattcttttctagctatgtattgaatatttacattatgccagatccagtacatgccattgttatcctctgtttttttttttttttttgagacggagtcttgctctgtcgcccaggctggagtgcagtggcgcaatctcggctcactgcaagctccgcctcccaggttcacgccattctcctgcctcagcctcccgagtagctgggactacaggcgcctgtcaccgcgcccggctaatttttttgtatttttagtagagacggggtttcaccgtgttagccaggatggtctcgatctcctgacctcatgatccacccatctccacctcccaaagtgctgggattacaggcgtgagccaccgcgcctggcctgttatcctctgtttatgggtgggaaagctgaggcaggaagccctttagtcacttgccgaaggccacgctgttaacggtcggaccagatttgggtggcggaagagaactcatccgacagtagggccagattcacgccccaggcccgttccctcctgctccctggtgctcctcacaccatcggccctgctgcccctcactgcccctgagtccctgtgcccgtgtcctccttcttgaacccatcagccgtcagttaaccctcagaaagctggctcggagaagtcctcatatggtaggaagagccccgttccctcctctcccggtgtcctggcccccctgcaaggtgacttcacctcctacatcaagaggcgggtactggtctccacctctgggctctgggccggcctcggatgcacttggccaatgggctgctcctaagctgctgtgggcagaggttggcacgacacttgtgcgctgggcctggacctctcttgcttggctctggggactgtcctccctgcaggaggcctgggctgggctgcaggatgagaggccatgggtcaggagaggcttctgtcgtcccagccggtccccagctgcctaaagatgggtggacaagcccagcgaggcccccagagaaccggcccatacgttagccaagttgccggccatgtaccatcgagccccgggctgtcatggtggttttgccactgagttttggagtgtgctgtgacgtgggaggagacattgagaggcctcacaagcctagaagcgtcttaccctgacctcacacctgctggacttcgggctgggaagagaactggggccgagggcgttttcccacaggactggaaggccggtcgtggtccttggtggtgagagctggccaggctgccagccttctccccggaagcctgcagggtcccctctgatccctgcgcctctgggggtcacaccaactgtgggtctttccttcctcaccacgctgggcacttggtgagcacattctgccttgagacggggcatttctttgataacatttcttctcatttcctgcttgttctggaactcctgtcagtcaaatgttgggccttttgaattgatcctgtgagtccttctttctacctttgcttgtagatagacttccctgaacccaaacacaaacactttctctctgctttttaaaaaattggttttggggccggacgtagtggctcacgcctgtagtcgcagcactttgggaggccaaggcaggcagatcacttgaggtcaggagttctagaccagcctagccaacatggtgaaaccccgtctctactaaaagtacaaaaatttgctggacgtggtggtgtgcggatgtaatcccagctactcgggaggctgaggcaggagactggcttgaacctggaaggcggaggttgcagtgagccgagatcaagccactgccctccagcctgggtgacagagccagactctgttttaaaataaataaataaataaaaataaaaaattggttttggattttagcagtcctgtttttcatttccaagacatttccattgttccctgagctcccctcttcttgttccagagaattctgttctgctcttagggataaagtggctttggggggaggcgaatcttttgctttctgcattttctctcttgcggttcttttttgtttgtttagtcttggagcttcacatgagactcagtgctcaaatgtctggcttttctttcttttcaatccctgtttataggggagacaggcagagctgccgggcactcctctttccttgttaacttgaggaagccggacagccaggtcttggaagggaggcctcctgcctccaggcggcatctcgggctgcagggctgtggtctggagtgcggacagtaccagctcccactgctgtcctgccatgcttgttcgcagtactcgtctcctcacaccagtgacgaggccactgcttgccagccgcttgccttcttcccgccaggctgtcctgctacgtcagcctccgctctccacctcaagaagtgtctcgaaatatcttctctgcagatgacctctctcctgttctcagtgccacgtggggcctccccagcagaggcggctggacacctggccctggctgctggaggttgtttagctgccagagggtggcggtagcctccaggaccctcccctggcctctgccctgttcatcctttgccggaatgtcatgggtttcaggatgtgctgagctccgaaaccccatggggcaacttgggatgggggctaaggaaggcctcttggaggagccctgaggcgaggtggccctggggtggggtggaggaggccctgagcagcaggggagggggttgcaccctgctctctgtgtccctgagtgaatggggcaggggctgcaccctgctctctgcgtctctgagtgagtggggcgggggctgcaccctgctctgtgtgtccctgagtgagtggggcaggggctgccccctgctctctgcatctctgagtgggatgggggctgccccctgctctctgcgtccctgagtgagtggggcgggggctgccccctgctctctgtgtccctgagtggggtgggggctgccctctgctctctgtgtccttgagtgagtggggtgggagctgcaccctgctctctgtgtccctgaatgagtggggtgggggctgcacctgctctgtgtgtccccagcctgctaagtgccccacaggggccaggatgctgaggagtgagaggtcttcacagagacaggtggctcctgtaataaggaagacaacactggcttcctgggcgaacagcagggcggggtccttaggtcccactgtaggtgcccaggcccggatgagattccccagtggccctgagggggcgcccgggacaccctggatggcccagtgtcctcccgtcaccctcgcccctgggcaccatcctccttggcctggaaaccccaagctccctgacgcccccgcccctctccccgggcctgtgccggggaaggatactgctgctccgtcagtcagccatagagcccctcctcccccagcccctctcacccctccctgtggtccttgccaatcgccctgagcccgaaaaggtgggagattcttggagagatggggccctggatccccggccctggatccccatccctggggtcccccactcacggggtcagatacgctaacaaaggccaagcgccctgccaagcggtgtcctggattggggtgggcgtgggggttcgcctcaggtccaggctccgggatgtcgtgcaggacagggcgcggttgcggcgggggcactggctggaagccggaactcccggcctcgagggcggaaagtgtggccagcgcagcgtgctgggggggccatggccccgttgccaggcagcgcctccctggacgccagttgccatggaagccgcttcctgcccatgttgccagggcgtccagatggcctcgaggagcctggttcagaggggccgccctatgcccttgcccctcctccgctgcccagggatgggctgggaggacaaagaggaggagaggctgggactcccagcatggagatccgagtccttcctgctggagccaggctgcggcccagggcaggggccagatggggctgttctgctgtctgcaccgcggacttgatgttcataccccaagctcattttatttattttctatttttattaagaaagagtctcactctgttgcccaggctggagtgcagtggcgcgatcacagctcactgaagcctccagttgggctcaagggatcctcccacctcagcctcccgtgtattggggaccacaggtatgtgccaccatgcccagataattctttattgttttatttttgtagagactgggtctcgctatgttgcccaggctggtcttgaactcctggctcaagtgatctgcccgcctcagcctctcaaaatgctaggattacaggtgtgagacacctcgcctgtgcttggctgctcccgagcatatctcagaagccaggaaacaggccctgaatggatggagctcggggtcactgggccagccacagccctcagaggaccccatctctgtgccctctaacctgggctcctggcccacacccacccaggctgcctgtcaggatctgctccctctccagccctcagagctgccctatgtggagggttgggggtcccagaaaacctgggagaaacgggtcctggaaacagggtcggggggaagggcagagtgctggggatgctgggcccacgacctccctgtccctggggcttccccatgtcagaggtgaggctcagagaggtaagggcgcaccctttgtctgccccctccccagcatggccaagtcgctcccagggtgcaggcgatggcaggccatttgtctccctcctgggtgagtctctggacatggattctcacattttttatttaagaatcagagagatataagaatgtcaaggaaaaatcctctcatggacaatgcagccccagtaaatgactgtcagccggcgtgtccagggcttcaaggccccaggaagtggccatgctggggctgccaggcctctggctccagggtcactggggctgaactgtctgcccaggcccggagacaccctgcccctgaggagcccaccggcttggccagtccatcttcttggcactccctgaccaccacttaccttctagtcggacagtggagcctggggggacagcgtggcagagtgcctgatggtcggtgacaaagtcatctccaaagtccttgctggggccaagagccaggactccttgcccgtccccgtcactgccctgtgcccgcccagcacctgctggggactaggctgcccattggagaaggaaacacagtgctgggctgtgagctcctgaagcctgtctctgtgccccaggaccaggctcctgggtggagggagagaccaggggcaggtgaggaaaggcagggcccccagaatccctccatgcctgcccctcagtctccaggacttatgtgcaggtaccgtttggagctgtggtgcagttcccagtctcaccaccagatggcaccatgcccctgcagaagcagtgcccagagcaggccaggtggttctcgggggctgcggtggaggaatccacccagccgaagctctggcagggaaggggcagtgctagggggagccccctccccacttggatccgaagttcccatggggcctagggcaggggcttgccaggtagccagaagttcccttgctgagtctagggtgtctatcccacatttcacatggagacgaatcatcccagacaccccggcactgtcccggggccgtttgccacccctcccaaggggcagggctcctgtcttggggccttcccaagcatagtagccttcgggcagccccggcctggccccaggttgtcccacttgtcagtgggcagctggggctgggggaggggtcccagctcctgtccaaggtcaccattgcccctgaccagggtgtggcagctgctgtggcctgggtcagtgaggccgtggacggagggtggcctgggtgtaggcactgctctcagctaagagagagcccatctggaggaagaaccaggaaccagagggatggccgggttcccagcgtgcaggaggccagcttaagttcagtagggtccccctgcagggactccaagaggcaaaccacatggagagtcacctgagagggaatgatggaggctggggaggtggagcccccacctccaactgctgcctcggcccccacagcaggggagggcgggaggctggcactggcactgccctgggagatgccacctgggccttggtctggggaggagggctggccaggaggctgggtacggctactgctctggagtgaccgaaccatttccaccctgcttgccttattcttctcatgagggcctcaaggggacacaccagaggtttactggggacatggcaggggagggatctcagtgctggccttctggggccctgcgtccactccgcccctttctgacctgggctggggcctctgccctccccggggcctggagacagagcccttttggaggccctcaggcttgacaagcctacttcttagagccaggctgtgggctgggctgtatcctggtgggatgagggatctggggcttgggtgggagtggggctgggagcaggtggaagttggtgcctcaggctctgaggaatgggcctgggatggctgcaaagtggaggagaggctctctcaaccctgggctttggggtctgagcccagccctgtcctcaggcagtctgcccctgcagccccgcattgccatgttggttggagttgcgatgagaggtgctggggcctcccttgcctctgcccagcacagctgagaagttacgtgctgctgcccaactgtgggggtttcaaaccccgctggagcctccaggtgggcccttgggcagcagggccttgtggcgggaggaggggaccctgggaagtcagggaccaggcgggggagggagagaaggtgggagcacagttgtgggtgtgggtacccgccccttcctgaactgtgttcctcccggcccacctgactctagtcctctgtgccggctgccaggggatacccgaggccacctgcgtccccaaaagaaggtctcaccttcagagccagcctttgaggctcctgggtgacctcagcctgttacccttgaccctgagttcacctagatcaagtgggaggccgctctttgggcctcagttctcccatcctcagggagtaggtcctctgtcccctgacagcacccctcctcgctgtgccaccaccactgccagggttctgatctgtggatgttccccagggggtggctctgggctctcaggcaaccggctactgtggatggtggtttgcacgagaatagtgtcactcttgggtcctttgcttgaagttggctctgctgagtgcagcctgcagacattttcaggaaactgaatccacaggctggagccttctgcttccccacaacccaaacggcccccagccagccaaacagccacgagaacccagctgctagcaactgccagcaggaaacccactaccagccgctcacagatggacagcccatcccaggagctggccccacctccccgcccctctgctgaccaacccagcagctccttgggtgggtgtggccaccctgctgccccaacctgctcccggaccctgtgccaggaggtgcttcgcctcagcggggccttgcctcccccagagccgctctgctgcctgaccttgcaatgtcatgggtcctctgggcactggcgcagttgggtgggatcagctttggccagcaggtggggggcaggtgggtaaatcctccctctctgccatctccgcttccttcctcctgcccggcttccctgcctttttcctactctggctccagggttgcactgctcagaaagctgttgctgcctggccagcacgcaggcctgattttcctgggagcctggactaagaccctgaccagtcctcccacccaccacccacaccaccacccagctagccagcagctaggccaggagtgatcaggagggggcccaaccgaccacccacccggcgtctccagccggccaactctgcccactcagggccgtgagctggaggtgccaggagcctcccgggaggcagtgtgaggcattcttcttagtaagtcccgcatcgatgataaagggcagtatcagcccctctctgatgcgcagtgagcggctcaccatacaggggaggcgtttaatttatctcgggaactgggcgcaagttataaaaatggtaatttcttggagattcaattacatgttttcattgttaccctcgataatcaaggaaacgattttttataaaaggctgtgggatgatactgatctcaggagaggatctgggccgggtgggggctttggggacgaagaggagggcagtgtctgctgggggcaggcagggcaagtggagctgggccggccggcccaccagctcctgcagcccaccagttcctccagctcctccagccctccagttcctctagctctccagctcctccagcccaccagttcctccagccctccagctcctccggccctccagctcctccagcccaccagctcctctagcccttcagcttctctggcccaccagttcctccagccctccagctccttcagccctctctggcctcagtcttcccatctgccgacgggcccatctctggtagggagggtctgcgttttggcatgagggctgatgaagtgaggcgtgactcctgggccgtgagggtggctgcgtccctgcccctcccttcctggtgcccgagcagtctcgtccatctcctgagggctctgcagggaatagagaggggttcctggtggagtgtggacctgattttttccccaagtgatgtcttggctctaaataacatctccaggattaatgatgccggcccccaacagcaccaggtgattggaaaaagggttttatggccccgtgggtgaaattgaacttgcatctgaggtgtatttccaagatgggattttcctccctggcagaggcggcacatttcacgctaatgataatggcagctcctcgacattcatcacctatagttggggggacacccgtctggggcacaggggcagggtgtccctggggtaacctccaggtctcctaatctcagcagactctggggggctggttctaggagatgcgccctcacccagtgcagggccagggaagggggaggcaggagcccccaggggatgaacgagctctagctgggctgcaccagggaggaggctggaaggaggccccaggctgagggtaggacccggctagtgcttgcccagggacccacaggccccttgctgagcagactccagcgaggggcctggcccatcttgttgcaaagggctagagtcctgggctgagctgggcagttgaccttggatctgactctgtctcccctgaaagctgttccaccccaatgcaggctcctgcagcctagcacagcgcccagccaggatgggcaggaggaagcccttcttccgacgggctgtcaccgcgccctgcctgaggggcctcaagccccagggctcttgtctcagaactgggccgtggagattcaggaactatgggagtttgggggatcttggtggctgagggctgtgctcatggaggactccttgagttcagaagatgaggcccaccttctgcatagccaataggtcattgtcacagggacactgaccaccagcaccaacctccatcccccggcacctgcctttatcacccatttcccaggtgaggacaggggctcaaagaggggcagggttcctctgaggtaacacagcaggtgagcaacagagccagtgagggcctgggggtgtcctgccacgggctgaggtgtgcccacatgcaggaatccaggggtccgtgggccaggacactgccaagagttgggggctgggggagggaagggggcattgccaatgctgcagcccctgccctggggggtaggagggagatgcccctccgggggcccaagggcagggtgggcccatgctgttccctcccacctgccacgggtgaacctgacaggagtggggatggagcctggcatcccgagggaacctcctggagtaatcactccacatgctcgcggtaaatactgggcccttcttcccctcccagtaattgaacttatttacttttaactaagattaaatgttctctgcgagctcaagatactgactgccctgtcaggctcagtccacgctctgctcttcctgcctctggggaccaaccccaggcagggagggaccaggcagccctggagaagcacagaaattgtttttccaggaaactctgggtggataatccacttacatcatcaccactgtcaccatgagcatggccataaccaccatcatggtcagctccaccagcatcaccaccaccaccaccaccatcaccatcactgccaccaccaccgccaccatgactaccaccaccatcaccaccaccaccaccatcactaccaccaccaccatcactaccaccaccaccaccacgatcactaccaccaccaccaccatcaccatcactaccaccaccaccaccatcaccatcaccaccaccatcactaccaccaccaccaccaccaccatcaccatcactaccaccaccatcactaccaccaccaccaccaccaccaccatcactacaaccactaccaccaccaccaccatcactacgaccaccaccataaccatcactaccaccatcaccaccaccaccatcaccatcaccaccaccatcaccatcactaccaccaccaccaccaccaccatcactaccaccaccaccatcactaccaccatcaccatcactaccaccaccaccaccaccaccatcactaccaccaccaccaccaccatcatcaccaccaccaccaccaccaccaccatcactaccaccaccaccaccatcactaccactaccaccaccatcactgccaccaccaccaccaccaccatcactaccaccaccaccaccatcactgccaccaccaccaccaccaccatcactaccaccaccaccatcaccaccaccaccaccatcactaccaccaccaccaccaccatcactaccaccaccaccaccaccatcactaccaccaccaccatcaccaccaccaccaccatcactaccaccaccaccaccaccaccatcactaccaccaccaccaccaccatcactaccaccaccaccaccatcactaccaccaccaccaccaccaccatcactaccaccaccaccaccatcaccatcactaccaccatcaccaccaccaccaccatcaccaccaccaccatcaccatcactaccaccaccaccatcaccaccaccaccaccatcactaccaccaccaccaccaccaccaccatcactaccaccaccaccaccaccatcactaccaccaccaccaccatcactaccaccaccaccaccaccatcactaccaccaccaccaccatcaccatcactaccaccatcaccaccaccaccaccatcaccaccaccaccatcaccatcactaccaccaccaccaccaccatcactaccaccatcaccaccatcaccaccaccatcactacaaccaccatcactaccaccatcaccactaccaccatcactaccaccaccaccaccaccatcaccatcacttccaccaccaccaccaccaccatcactaccaccaccaccaccaccatcaccatcacttccaccaccaccaccaccaccatcactaccaccaccaccaccaccatcaccatcacttccaccaccaccaccaccaccatcactaccaccactaccaccaggaccaccatcactaccaccaccaccaccaccatcactaccaccatcaccaccaccaccaccaccatcactaccaccaccaccaccaccatcactaccaccaccaccatcaccatcaccaccaccaccaccaccaccatcactaccaccaccaccaccatcaccatcaccaccaccaccaccatcactaccaccaccaccaccaccatcactaccaccaccaccatcaccatcacttccaccaccaccactgccatcactaccaccaccaccaccatcaccatcactaccaccaccccaccactaccaccatcaccaccaccaccaccatcactaccaccaccaccaccaccatcactaccaccaccaccatcaccatcacttccaccaccaccactgccatcactaccaccaccaccaccatcaccatcactaccaccaccaccaccaccatcaccatcactaccaccaccaccaccaccaccatcactaccaccaccaccaccatcactaccaccaccaccatcactaccaccatcaccaccatcactatccccaccatcactaccactgccaccaccaccaccatcactaccaccaccaccaccatcactaccaccactaccaccaccaccaccatcaccaccaccaccaccatcactaccaccaccaccaccagcaccaccaccatcactaccaccatcaccaccacaaccaccatcaccaccaccatcatcagaaccaccaccatcaccatcactaccaccaccaccaccatcaccaccaccaccatcaccatcactatcaccaccaccatcaccatcgttaccatcaccatcaccatcaccaccaccaccaccatcaccatcactatcaccaccaccatcaccatcgttaccatcaccatcaccatcaccatcaccatcaccatcaccacacctccatcactatggtcgctgtgactgagcccatcctcactactgtcatcagcactgtcacagcaccatgctgacaagcccacagtgggtttgagggctgccattgcttgggactagttcctcaggcacaggaggctccacgctggtctgattgcattggaggggatgcctgacaaaggtctttatggggtgtgcattgtggagtggggagggggaggctcagggaggtctcgaggacttcatgccgtgggcattctccccggcccccttctgtctcagcagctccccacgcttcttgactgagctggagcagaggaagcaggcaggggtgggaggaggggcaggggcaggagaaggggcaggggcagccacaaccacctccacttaggttggagcacagcctcctggcctccctaaagtgaagggccacccagaggaggcacctaaccattctcccctccggactccacccagtgcttggatagccagcggggcagcttggggtcggggctgggcactcagccaaaggggctggagagcatgccgtgtgcagagcctgctcccatgaggtggtgagagcctgctgcactggtctcctgccccgagccttggcttgctcatctatgaacgggtgacgtggtgcctgctgcacagcaggccacaagagcagagcgacaggacacagtgaggggcggtaaggtgctgcctggtaagagagctgtgggctggcctcaaggggtagcctgtgtcctcttgctgagaatagtgggaagcgagctgcgagcttgggcccacagtggtggtcttaggctgccgtggtcacataacgccacctcccagtgcctgcggcaccacccctgggctccgcagccccagccagccgtccatgtggcccatcctgtcctctccaggcctgtctgtgtgcacccagtggagggtctcctgtctcctgtggctccctgaggctgctggtcacagagctgatgaggacactagagaccgctgcggggctgggcgggggccctgtgggagcgcagcagcctgggatctgcagctggggctgacctagcacagcaggccactgatgccacctctcaagtggcaggggcttcacagcctcccactgcaatcccggcaggcctcggtgccagggcggccccatcctgggggccactgaggacctgcatcggccacagggctcgtgagcatgggcaccccagggctcagtgggggcagctagagggagggttcagtcacctaggcctgcccagagccctgctcagggcccaggatgaactgatgggggcaacctgcaggcggtgccagcgagagtgggcgctccccacaacaggggagccacagccagcctcaccgagagcagggagggaatgtgtggagatgcaggaaacctctgccacgtccaggaaatattattaacaattaaaaattttaaatcttggtaacattcccgatggccagataattaatataagagcagataataattactcaatgattaataactgcactgaatagttttcaaagtaattgtgataaagagaatgttaaatgaaaacccatcaaagttgctgatgccctgcacagcgagggcaccttagtgctgggggtggccatgtcgactgggctgagactggccccccgggcccactgtgtcctggtggcacgtatggagtgtgaggaccacctccccaacacacacggggtgaggaccctgcacgcacatgcaaaggcaggggtctctcttagtattggggcaggtgggcagaacctgtctctcttcctgcctcactgggattgtggatgaccatggggttggctcaggagtctgccctgtgcctgcagatgttctggatatctgggctagtgttggggggtattatctgacccatggaccagtctctggttcttctattgccccagccactccaggcctttggtgaaccccctctaccattcaacttgacctgccatgttcctgagatctagcccagggctactccatccaccaattctcactaaagtgtgagtggttgcttggcactaccctaatctttgccgcctcatgtgtttattggtgtgaagccttcagctgcagggggatgaagaaggtgattccaggcagagcaggcctgctccctccacccttaggctactgactctgcagtcctggacagtggctgggagctaccaggagcccaggttggggcaggacctggggacctactgcccctcacataagccagtttctccaatcctggttccttgccctgtctgccatgcctcccagctgacaccaccgtgcggctccctcacctcatcctctgaacaggaccatcctgagttgtcacagcttccagaccccccgaagccacctggtcccctatcaggctgaggctgtccagacatggcctgccacgaggccctgagtggatatgctggcctggacaccaaggatgagggaccctggcacttcgcatctcagggatgccgggtgctcacccgcaaagacccagaggagagaaggggagaaaaagtctgaagggctcgtgaccaccctggggtcctgatggggccaggcacggtggccatacttgtaaccctagcagtttgggaggctgagatgggaggactgctgaaagcctgcctgtgcaacaggcatagaaggccctgtctgtatgaaaaataattagctgggtgtggcagcaagtgcctgtaatcccagctactcaggaggtgagcccaggaattggaggctgcagtaaaagtcatgattgtgccactgcactccagtctaggtgacagagtgagagccagtctcaaaataaaaaaataaaaaataaaaaaaaagaaggactcctggatcaccctggggccgcgcagggatgggtgggctctggaggccacaactctattctaaccacagtggtaatgatggcttcgggcaggaccactgatggcacagaaatcaccgggtgaaaggctgatgcagatgggcctgtggctgagctcagcttccccacaagatcctgcttccagaaagaagaaggcgtcctcctggtggagagccctcggagctcagcccatgaaggagggacatgtggtgcccctgctgcggctgccgctccccaagtcaccaggaaatgcagaccactgtctgcggccactgcattgcttcccttgttcagaggtcgtcatcccacagtgatggcaaagatggcagtgaccacggggcaggggagagcccagtaggcgatgggccagacaggtgcgggcccgggcagggcagatggggcgcttaaactgctcttgctgcttctttgagagttaaatgtttcaaggcacaagactttaaaaaggaggcacctggagacatgaaggccaagggtgacagcctcgtggggagggccgttgggggccttcccgatgctcggcacagatgggcactgtgggctatgggccgggcaggtgtggtcctggcctcaggttcctgtctcccacttctgggagctctgcctcccttgtggcctctgtttcaaggtcatttctggatgggcaaactgaggccccagtggctggggttgtccaaggtcctgaaggccagtgttggagcctccgggcacttggcccctgcggcccccacgccgctacccccagcccaggccctcaggtccagaacctcttgccctccagcctggggccactgttctgagagtgtgccccgaacgacactccctcattagccgagtcccagctctgtgttctggggttggagctctggggctgttgtcctctgggcctggctgctcactgaggctcctccaggggccctgccacccaccttgtgtgcctgcagatgtccttcccatgcgagcaccagtgccacagccctgaccccccgccctgcctaccccatcatggctcgccaccagcccagctgagctgctaccccgagcccaccacttccctaagccccagcttgctcctggcacctggcatcagcctgggaggggctgatgatcttgggggaggatcctgcgacaactgccgggcctgggacagtgatggaagtccaggcctccagggaggctaggaggctggtcccagtccctgctcagccattagggctgcccctccccatgttggcctcagtttccctgtgcgtagcatgggtttgcggtaaaggtgatgcactgccatggcaaggtttgttattgagggtccttggagcggggccactgcagcaggaagtccccgtggggccccctgcgtggggttggcctggctcaggagatggtcccggctgctatttcatgtatcgtgaggacaccgaatcctaccccaaggccatgagggcagaaggccaaggctgtgagccttccctacttggagacatttgccctggggagcggctgttcccagaccctacatgcctcccccacgagtgatctgcggactggggagggcactgcctacatctgccccaaaggcagtggcagaggctttgtgggatgagggtggtttgtgctctcagaggcactgggctcagccagcggctgaggtagagctggggccctccggggcaaaacatcaaaagtctctgagctcctgtccagggcttggatgagttgggattggtgctgccccagcacccaggattccccaatgcacctgccacctggcagtccctccccagggctcagcacccaccatgagtcctcaaggatttgggtgattcagtggcctgcctcgctgggcctcccccttaataatgcattcttgctaataaccttctttcctgtgtgtcattaaacacatcctcctgctggtgggtagtggagcagccggtggtggctggggaggcccgggcccccaggagagagggaaccctgggaggctggggggtaggaggggacagggctggtgcaccacctgagaataggtacaggggctccagctctgggcagcatcatgagacgcttgtggggtcgggggcggcagggcagaaaacagcctacaggggccaggctgggggctgccctcctcgtcctgtggtcactgggctatgggaatgggaatgagggcagggcagtgctagtggcccacagccctggggggcagcagcccagggatggttacaggacaaggtttgcgtaaaaccaggcttggaggccggtgtggggtgatccctcttggaggtgaaggaagggagcagtgtggcaacgtcctggaaatcatggtcagagggcccagctggggcgtgtggcctggaaaaggcactgcccccacccccaccagccagggtctttcccttgcccctgccccctcctcagggccccgccctgtcagccctgcctgtgggtttcagccccatgggcagagcatcagacttagcccgggtggaggacatggtcggtcctgcgggcaggtcgggggagtcccaggccagggcccaaggccacccgggggcagccctgcccacgcctcatctggtggaccagggagaagtcctccatcaggcatggttacaaaacttctcagacttaattaaagtcaatctccagttactcaaatgccattgatttggatctcgactgatggggaaaatatgatcatcatcatgggaaacatcgataggaaggcgctgagtacctgggcacagggccgatctggagccaacacagtcacggagcccctgctctgggcccgaccacggggccctcatgcagaacccttgtccaggcccttccggaagggtctgccacttgctgcctgggtgtccctgaattctcaccccctggctgaacccaggggcctcacagaaccgggatcctgcagggctgatgggaggctcaagggtgcgtgtcttggggccggcagcagccagcgctctgtggagaccgtctaccctcgtcacgtggctggggtcctcttgatgttgcaccggggaccctgggctggcaggactaagtctaactggggatccagggctcctgcctatcagcccccagtgagtgagtgcaagagggaaggccctttggccagtgctgcaccttttacttgcgtgggctttgaggcttggacccagcccgaggcccattgggcagcagatgtcagcacctctgtagagggcagctgaggccagacttctccatccagcctcagcagagaagcaagggcggagagcaggtagaacatcaaggcggaaggaggtgatgctgttcgggggctggggagaagtgccttcaaccagagcacctgaggttctcttctggccttgcagcctggagcctggtctggggctaggaggtgtcgcagctgtgaggccccaagtgcaggcccaggcagaggagacctggaggcagctaatgtgggggagagttgactggggatcgtaatctagttttctgtttttccttggaaaaagaaagacaaagtccccaactcacctgcccttaaaataaaaagtcacaggctgggtgcattgcctcatgcctggaatcccaacactttgggaggctgaggcaagtggattgcttgagcccaggagtcgaagaccagcctgggaaacatagagagggaaaccccctccctacaaaaaaatagaaaaattagccaggcatggtgtcgcatgcctgtagtcccagctacctgggggcctgaagtgggaggatcctttgagctctggaggtggaggcttcagcgagctgggattgcaccattgcactctagcccgggtgacagagtgagaccctgtctcaaaaaacaaaacaaaacaaaaaaaaccaccaaaaaccaaagtcacataaaatgtcttcataaatacaatagaggcaaacctcatgtgatttgtgttcatggacttggaggggccaaaggcccaacagaagtgagaggaggagggaggggaggggtgcaagggccaagggtagaggccgggaggggccagcatggtggcctgagtccactgcaggtggcactgctggctttggtgtcctcatttcatctcctgtgacctctgcccttggcatgtccccaggtacctcctgtgggctcctggctggggtggggtaggaggaggaagctgagggtggccagggtctgtgtccatcgaggggtgtccaaattctagtggagggagggctggaggggagtggggaggggcctttggccaaagccaggtgctggggtgtgacggatctccacggttgctgggaccttgtggccattcctgggacatggctttcaccttaacaagggccctgggtgttccaggggtccccatcccctgcccctgggggctcagcacacaaagcccagcctggggcctgggccatggtagccagggaggtcagggtgtgaggccttggtggcctccaggtgggcggtgagccagggggtgtggacatgtggacagtgccgggcctgggtcatgcacttcgtcaacccttcacgcctagaccacagcctctctgagcagggcccagcttgcgttgtgctgagtcttttgttactttaattaatgcccagcttcctgacgcttaattaaactggaattgctccatgtccaatagccaagcatcccattagatacaagttaatgcaactgtcgcagtggccatgaaatgaggctggtgcgtcccccagggagggatgcagaatgcatcttggaggacagcatggcctgaccgggcagctgcacacagggccaaactgagcccgtactggacagccagccctcagcccacccagtacttccacaagacccttcccaggcccctcgaggaggactccccatgggggccctggcctccagctcctctgcacgcccgagggcagcctgcttgcttcctgctgaggtttgctgttccagctccatgagaaactcatgctagtgtatcaacatttggaaaatgcagaaaaattagagaaaggaaagtagggactccccaccccagaaaggtgccatcctcccatgggcctgcgttttgggctccgtaggggctacaaggtgctctctggggcctgcagtgggggccggggcaggagctctgggaaggcgtgggggcagaggccacattgtgaggagccattggttcttcaggagccggaagttctaggatggggggcagggctgggagccagcgggggtgaggcaggctggggatgctggggtgataccttgcacccaccaatctccagtgccagcctctcaccctgatggccccgtgtccaaggcagcctcacggtgccctctgccagtggccaaaggcattgtgcctggttggtccatcaccccagagtcttttaaaattaaattaaattaaattaaattataattaattttagagatagggtctcgatctgtcacctaggctgaagagcagtggcaccatcacagttcactgcaggcttgaacgcccacgctcaagtgatcttcccacctcagcctcccaagtaactgggactgcaggtgtgcaccaccactcccggctaatatttaaacacttatttatttatttatttatttatttgtttttagatggggtcttgctctgtcacccagactggagtgcaattgtgtcatcacagctcactgcaaccttgaactcttgggctcaagtgatcctccagcatcaacctcccaagtagctgggactataggtgcaggccaccacacctggctagtttttaaagttttttgtagcgaggggctttcactatgttgcctagactggtctcgaattcctggcctcaagcgatcctcccaccttggcttctcaaagtgctgggatcacaggcctgggccaccacacccggccagcccagactcttggttcaatcccctagagggcttgagtggggcaaggaggtggcaaagtgggcagcaagggggccgccctggacaggtctccctgtccccctacccgagggtactgagcggcctctgcattgggctcccaggctgggctgggtgggtctgaggcaggagcagcctccccctggaggccagctcaggtggcagaggcccggtctgccccgggtctgcggagccgagggcaggtctctggtgcgtaggttgctgggcctggctctctctcaagcttgtttgctgtttgggtcctcctctttggggccagggccacacgcacctctgcgacattagcttggtgcctgtgaggggctgggtatctcaggagatcgcagcaggtcctagcactaccctgttgcattcttcaaggactccccgcagcccagtgtctgtggagtggggcgtgaggtgctgcctcccatgttgctgcttagaaggacgcagccctggaaaccctcactgtggagtctctgagcccctcatccgcagagcagcagttgctgctgtttgcacagacagcaaatccggggcatgtttgtttagtaagattacctctgctggggcctggcccaagggacaggccaggcacagaggggtgggggctctgtgcatactgaacacccccccgagagtggctctgtctacagccggaccactctggaagtgacggcactgcgggcctggagggctggggcagtccaattgggcaccatgccctcacaaacaacacacacaccagcggtggggttgcgagggggcgctgagggaggatcctggctgccctgcttaagccctgcagcctgtggggctgtgtccacccgggtcgcatgttgcttctacctgcacggtggccccaccacacaaggtgccgtcctgccctccagtcaacttcctggggctctgagcagcctgtggtggcacctcacctgggcagagggtgggaggagcagcgcccttccttctgtgcagggagtctgatcagggttctgtctcactgtgggacagtgggggccggggaagagcggcaggtaccaagtgcagacagcagatgtagatgcatgcgggggtccgggctggggccaagaacacagccctggagtcagggacaccggcttcatgtcctcactctgccattcaagagctgggggacctcgggcaggtggtgtaggaacagggaggagtctgcctgcagcacgcagaggagggctgtgctggtcagggggtgttttggggagaggacctcaaagggaggttgactttgggaaaggggtcagagtacagaaaaagtgggtccaaatcctgcttcagcactgagaccctgcctcggcaggggtctccaagcttggctccaccccctgaggggccagttactgcatacctcgcccacccaggagctgggggccctggtcctgtttcccagggagctgttggcacttgtgggctcctggctggggtccaggtgggctctgctcctctgccctgcccagcgctttgtactgagcccatcctgcagagactcaacggggccaaacgcacattccttgaccttctgtgagtctgtcagtcttcatccctccctggacctaggaaggcctggacagctttgaccattggtgttgggtggacatggcgctgcgctgcaccccaggccctcagagcccagctgttctgctttctgcttttggtcctgagctgccttgaaggaatctgaccagcagggagagcccacggagcgggagggcctgtggggctcagccctgcagccggtctgccgaggccaggcctgggggcacagctggggctgagtacactgaatgccccctcgatgccatgcacagcagaagagctgcccacaccgccctgctgggccctgcccgggctccagacccacagaccaagcacacaagagactgggctgctttgtcatgcagcagcaggtagccggacacatgtttccccattcccctgccatcctctgaaatcctgtggggagaaagcatgtgaggtccagtgggggttggggtgagggtctgactgggggctttctaacccacgtctgagtcccatccggcgccagtgccacagtggcgggtgactggtgctgctcacactggcaagctcctacctagactttggagcccaactccacaaggcccctgaactacccctgtaggcaccgcagcccccttgccttcctctgctacgacatcaaccactctgatggtatttgtggtttgatgtgtttaagtaaaaggcttgttgcagagtttaattgaccccatatgtctgcctgaggaggccgtgagctgcagagggcaggtgtgagctgggctctttcctcagtccccatgtcttgctgggtactcacagggcacacacgagcacgtgcggcaggggcaggggccagcgggggatggggaggcttggcgcccacggccccgctgccccatgtttccactgcagccgaggagaaaacgaggactttacggctgtcacaaacatttcatcttgtgcattttacagtccacgactgctgtgaacactggggctcctgtcggagctagaagattcataaaatgcatgtgaattattttattttattttattgttttgagatggagtctcactctgtcacccaggctggagtgcagtggcgcgatcttggctcactgtaacctccacctcctgggttcaagcaattctcctgcctcagcctcccaagtagctgggactataggcgtgcgccaccacgcctggctaatttttttgtatttttagtagagacggggtttcgccatgttagccagactggtctcaaactcctgacctcaagtgatcctcccacctcggcctcccaaaatgctgggatcacaggtgtgagccactgcgcctggccaaatgcatgtgaatttttatgttcaattattccaggttccctgctcggggcccatgggcttccccatgtacaacccaccggtaggtccccgcccagtccatgctcctcaaaggccagcctcacacccatcccacgtcctcttggctggtaaacactctcccccttcttccttctccctccacatctcaactgctggaagggaagagctcctcagtctacttggagtccctcctgcacaagaggatccagggtggtccaggagggccaaacccacctctttgggtgcacccctgggcagtggattggggatccagggcttgtgggggtatgcacccaccagggcaggtccctcaggctcactctccctgcgcctcagtttcctctcctgaaaaatgggcttgtgactaaatgttgcagggagctgctgagaaaacgcctgctgaaagcttggcaggaggtcattgtgaccagggatggggctgggtgcttcggtcaggccagggctggaggcaggggctcacactggggtcagcagtgcaggggcgtggctggcgtggcaggcgcatggggattggctcatcagttgcggcctcacgtcccttcgttatggcgcctgcagaagatgttctctgattagtctgctgaattatgaattaggttccgggtccctgtgcagctgttcccggcttgtcatccccaccactttatttccccatctgtttataaaaccaggagcgccgtcctgcaataaacacttcaaacgctttttttaggggctaattaattgtgttgcatttcttcgacacagcatgcaggccggacctgccccgaattcccaatgcgggtgtggctcctgctgagcgcctggggagggagccaggcctggagcctggggggctgcatgtggccgccccaagtttgttttctccaaggcagccctccacctttatgtggcgggctgggctgtctcaggaatgcgccggccatgtcaggttccccctagattccccctccgcaccctttggctgaagtcctcctgctcggaccataggacactcttgaaattatctgtggcacatccaaggtcaaggtcacgccctgctgccagctacagtgctgaccctgagggctccacctcccaggcccactgagcatcacgctgtcttccctgccttgcctgcccagagcacctctgccctccaggaccccctcagcgagtgcggtgggcgagtgcagtgggtgggtggcccatctaggcaagccaatctctcctcggatccgtgcacctctttggagaaggcctctgggagccccagccctgctgtgcaccctgaggcctcactccgtctgaggaacccagagagcatcgcggaggaggcttaaaacaatgacaataagaaaacaaaatcacaatcaccaagtcacgaaacagctcagaggcaattgagttaggcagccccctgccagtgcccaatgccggtaaagtggctctttaggaactgagtcctaatgtgggctgcgcagcgggtcagaggaggtgttcagcctgtggccaggcattggggccccaagccagtcctccactgcggacagaaccttgcccagctgcagctggagcctgaaggcatccactgcgtgcatctggaggggtcgggggttctttgtccccaaggccactgtggctcctgtgggccaccgtcatgtccactgggactggtgggaaactgggtctggggacttgtaccctccgcttcctcatgtcctcatcctcaggtgccctcccagcccttcaggggtcctgttttccagctgtgggcaggatgttgctcctctgccctgtctgtccacgactcagggtgccaaggctggtggagcctccctgcagccccaagggaggaggctggggccagagacgccctggggtggggcacgtctcttcccagtgaacctcagatccctcgggcgcccacgctccccactgagggcctggggccacagcactctgcctgtgaggggtgggcccttggaggcttggggacatgcgcgcccacaggcacgtggggagagcctgctgagcgctgtctcagtgatggttccccacactggcccctgacatggggcttggtgtggcagcttgttggggaggtggtgcgtggagcaggatggggaccgggaggtggttgctgtgggctctgcggggcgtgagggccggtgtttgccccaagctcagtgcctgcctgtgaccacaccagctcataagtgacctctgggtggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcggagatggagacgcgcttccctgtgtcggggcttcgctcagaacatttttatgggctgttaattgttatgctttcatttaattctgggtgtcattccatgtcagccaagcccgacaggctgggatttatgcttccaaattatggggctcgggctgttcagaggtaaaacaattacccatcaatcagccaccaaccggcttgtgctggggctggcagccccattagcgggcgtgggcagccatggcccagcaagaccccttgagggacaggactgccttcgagggcaaggcagtctgggtgaagtctcgccccaggttggccctgtgctgtggcagggcgcagctctctggggaggcggccgctcagggaaggaccccagggtccacattcacacccaactggctccagtgctgcagccctcggcctcccatatgatggtgtgaccctaggtgggctgagggtgacccgccggaagacgctgcagcatcaaggtggggggaccatgggtcccatatgctggggcctggggagccttggccagccatggtcactcagtgggaggggcagggtcacctgcctcctgagcaccccatccccaggagggagggaccaggtgtgacccacttcacagggagggaagccttggctgtcagaggggacactgcgtctctcactgggaggacctcccggcctgggcttgaggcccacctggatctgtgcaaacgtagatgtgggtagggtggggcaggggaggggaggtgggcaggggaggtggagtgggctggctgtcagctcaggagtgggggtcggggaacctgggccacagagcggatcctgtcccaccttgaccctggtatggttgagtcggcggctaagccaggccccgtggtccttcacccagggagagcctgtgccaggccaggcactgccaggccagcacacagccttgactgagcgcctccccgtctcaagttgtctcctggatgcccggctggctgctcatggggacaggggcaggatgggacagcgagaagaggtgggctcccccagccccagtgaccctccaggccagggattggcttctctccctgcagagatcgcccttccctgcccctctgcccagctgccctgggacttgtgtcccagccctgcccagcattcatcctgggtgatctgcacgtgggcatggcgcctcaccgggtcagggtggtgtccaggtgagcaggcggaggactctcctcactgcccagcagtgtcctgctcccccagctgctctgacagccaaactggtccccagctggggcatctcacgcccagacctgctgcccgttggtgcagtgcagcccccgccaatgcagacactgtacctcggtctccgggaccccctctgcccctgcaattcgacgctctgctcctgccctgctgggatcccacgtccctggaccctccctatggcagtctcgccccgcgaccctgctacaggcctgccctgccacccccgggcacactccctcatccagagtctgtgcagtcacatgtggacccctgaggccggcctgcggctccctgctcacgggcggctaaaagggggctttccagtcacgccctgccctggccttctgcctaaggccctggccctcatgggccaggcatggtcctcaggcccttggctctgccaaggctctgagaccccaccctagagagaccctggcccacccagcctggccctgcagcagtgccccaagtgcccccgagcccggcctggctgctgccagggtgaccaccaggggcagtagtcagatagagggcggtggccgggcccagtgtgtctgggtgaccgcagggcctgaaggtgtggtggcccacccgggtcagagtgaaactgaactcctaggtcagggtcgggtcctcccagggtcgtgtcctctggaacttggggcgagtcactacgcctcagtgtcatcgtgggcagaaccttccacatgtggcattgaaatctttcaaattgaataggaaaagccccacgttttctgagccctatatatagaccagtactgtcctaagtgtattctagggaaagacagtggccagccctgtagctcagttatttctgtttaaagtgtgaacgggctgggtgcagtgcttgaaaatcaagcatgaagtgaaacccagtgggccgtgcatggctctgacacccatgagtcattcacacgatgccacttgctcattgctgtcccaccccaaatgcagcactggtgggcgagaccctctgggcatattacctgcgggatgtggctccagcgcctcacttccagctcactgctgcctcaaactcctggactcaaggaatcctcctgcctcagccttctgaatagctgggactacaggcatgtgccgccacacccggtgaattttttttttgtagagaggggttctctctatgttgcccaggctggtctcaaattcctgtgctcaagcgatcctcccaccttggcctcccaaagtgctgggattacaggtgtgagccactgcacccagcctcttcaccctttaaacagaaacaacaactgaacatacagggcagaccagtgtctgtccccagtgcctgtgctgggggtgactttccagctggggctcagcattgcgagtgggaagacctcctggggccaacatggcttggattgtgagggcacgtgggtcgccgtggggccagagtccagcagtggcagagctgcacagcagtggggaggggcagggcagggcagggagagggccccggctggcccggctggcccagcctgcccagggctgcacggtttccatccctgtccccagctgcagtgggacacctgccatgggggaggctgggggaggcctggggtggcgccttgggctctcagccaggagttcgctctctccaggtcaggctggcagagcagccccagggcccctgcacccccactgcccatgcccaccttgggctctctgatgcccggcagggcctctgggcttctccctcccaagcttgggtggcaacgctggcatttggagcctggggagctgctgacagtgctggtcctgcccgcgaaggaggcggtgccaggctgtttggaaatgtcaggctgatgggtggtggcactgcccagcaccccacccccgctcccaccccaagaggctggacacgggctggggccccggtgatggagccaggccgggagccaggagatgctgctgagcagggatagctggctgagggctcctgggcggcaggggatccgaggctgatggacaaggggcctctccttgccaccgcagctgcggccttggtgggccggtcgatgcggaagagtgatggtgcacgtggggccgtggggtgtcggagggaggtttattgatgtcggctgatttccctgggggccccttgctggcagcagccaccatgctccccgagagctaaccgtatcaggccggaagggtggtgggcagtgtgatggatggactccggctgtcggctggctgggcctggatggagccccgagatgggcacactgggccgtgacaagagtgccgtggggtccctgggggagcccaaagaggcctctgagagggtctgtgctgggaggtagacctgagagaggggagacaccatcccagggtgggcacaggcatggggcagagggcacgtgacgccaacctagggccccagggggtgggacggaggggcctggttctggggcattgggagaggcctgggactctggacctggtctgtctttcttgtccccagtgtgagcaccagcccttgcagctgagccctgggaggcgcctcctgcccacgcagcaaagctcagagctctgtggcctcctctgggctcctgcacagcgggtttgctcccagctgctcccctgacacggacaccttcaagggccacgtgactgccatccccaggccttggccctcgatgaggaagggcccttctcaacctgtggctctgaaataggtctcatgatggtgccagtttaatgacaggagcagtggctaatccagtggtcattattgcatgggctgtcatgcccttctctatccgtgctccctgaagaggcgagggtccactgccggctgccacacagagaagcatggccacagaaggaggctcctctgctctgagtgggatgttggctcctcgggccacactgggctggaggacaaggggaggcaggggtgggagggccctgggctggggtggatggggtgggcctcacagatggcatggccctgtggacagcgagtggcttttcctccccaggtctcgtcctgagccctgctcctcctcctggcctcccctggccccacacctctcccactggcttcctttcctggcctctttctctctgctccttgtctccatctctcattcctctgggccttgcttcacggagtcaccagcccgtgtgacaatgtccactttccctggcctcatgtctccaacttagtgtgggacctgcctttccaggctctttggccacatgagatcatggaaacacatggctgctgtacccacgctgacctggctcagccctggctcatgatgcttcctgtgcaccctggtcccatctgtacctcagtttacccatctgccacacagggctgagggcatctgccttgtgtgtggcggtcaggctggcccagtgaccgccgagccattttggcttcctcaggtctggccactgtgaaggacatggctgtgccccccgtctgccctgtgtggccctgggcacattaaccccttccataagcctggtctgcagacgagcgcccaccgggctggcagtgcctgaagagtctcgggcgacgtccactcacctcccaatctggtcccagctctgctcaaactcagactggaggatcccccagggcagtgactccagttcagagtctagctgactgcgtccctggcagccaggcacggcccaaggtccagagctggagactgacccccctgtgtaggacctctgggaagtccccaggacccaagacggctcagggctagtgaggtagggacaggtggctatttcaagcccccagcgggcttcctgcctggggcacctgggcacagtggagaaagatggctcccggcagaacacatgcccccatccttcggggccagatgccttgggttgggcacggagcagggcccccagcagacacagaggccagggtgggaagggccagggcaccgcgcagtctcttgccctgtgtcagggctccaggcctatggtggggctgggcctacccaccctgtcactttccccatacggctttggggtcccaggggttcaggggcccctcctgcctgacccagccttaactttttgttgtttcttctcattacaaaagaagcatgttcaaaagaaccccacagtcctccatgaaccccacagtaccccgtgaactccagagtcctccatgaaccctacagactctcatgcaccccacagtcccccatgaaccacatagtcccctatgtaccccacaagctcccatgtaccctatagtccccgatgcaccccacagtcccctatgtaccccacaagcccccatgcatcccacaggcccttatgtaccccacaggcccccatgcaccccacagtcccacatgcaccccacaggctcccatgaaccccacaggcccctgtgcaccccacagtcccacatgcaccccacaggcccccatgaaccccacaggcccccgtgcaccccacagtcccctatgtaccccacaggcccccatgtaccccacagtcccctatgtacctaccccacaggcccccatgcaccgcacaggcccccatgaaccccacagtccctcacagcccccatgcggggaaagggcctcacttctggccgctgactgacttgccagtttcctggagttctttatccaactttcaaggttgctgagtcccgggaacacctcagaaacctcacgaaacagtgacaggttgtcaatcaagcagcaaggttgacatgtttgagcaacgttcagcctgggaggcgctggggccaattagcagagactcccaggtagcagagcccccgggctcatggctggggggtggatggtcagccctgacgctgctgcccccacccgaggatttctccccagccatggacttggggctgagggattcctgtaccctcccggccacctggacagggtccccgccgtggcccggcctagggcgttggctcagaccacacctgcccaaggatggagcctgacacccaggaagcagctccttgcagcgccctgggcctccgtggggcccctcttggcagagtgacctggggaccaacccccttctgtgaggcaggtgaggatgctgccttgtgggctgaaggccaaggggaagaggcatactggggccactcaggctgagcagtggtcacagcggccacccctccctctccaaggctctggcgaccactgttctgtttagcccctacccctccccaccttttaaaaagacagggtctcgctctgtcacccaggctggagtgcagtgacacaatcagagctcactgcagcctccaactcctgggctcaagcgatcctcttgcttaagcctccgagtagctgggacaacaggtgtgtgccaccatgctcagataatttttttaaaattattttttgtagagatggcggtctcactttgttcctcaggctggtctcaaactcctggcctcaggcaatcctcccttcttggcctcccaaagccctgggattatgggagccaggttcccaaacactctctgctcttccctccacctggcatctccctccccaaagctctgccccatcctgaagtccccactgcagatgctgcccctcccagaaggtagctgggcatgggctctgcagctgcagagttatggactgggcctccctgggcagcttcctgggagctgcaccatgcacgggtcacgggaccctcctgggtaggttgaactgggaggcgacagagacccttctaaagtccctatgccgggtgctgggctgtagtcacatggtgccctccccaggaatccctgaggggtgggtgcgtctctctcagcagcaccagcaaggaccagcggggaggggtgagcatctttgttctgtccaagagcctctttggagcacgagcacttgccacatgcaggagagagccatgttcactttccttttatggctgagtttgagatgtctggatagagagttatcagccaaggcactgataaggtctgcggggggaatatactgtaaagggctgagcgtggagtgggggctacctctcctgctcgggctggtgttgggggttggggtgggctgggtgaagctgccactcctggcctggatatatggagccctgggcagtcctgcctgtcccatggctttgctggacacaacaagaactgccagatgtcatttgtgtgggaatcattttgctgtttgagcgaagttggatttgttagtgtgctcaccagtgtggatggatgaggtctgaccaggaggctgcctgttgtctgtctttcacagagggccctccacacccagggtagagctggggagaaggagtcctggggaaatactgagttaaacaaggctgatgtatcctctgcaggacttctcagtgcctttagcatggcgggtgtaggtgagtctaagagatggccaggtagcctaggtgtggatatcaccaggctagggctgctgtctgtctcctctgctcacgctcctgtgcagggagggacttgagggtgggcctggggaaactgtggaaagtaggagtctctgtccccagacactgtctctgaactggggccaagattcagtcatttcatgtccccactaggcagtgcttacagatgttgcccagtatcagctgcattgattaaaggaagagctttctgaccatcaggtgggggcgctctcctggtgagtggggctgggaggcagagccctgtcctccgcggtgtgactgggacgtaatcccctcctggggctgagtggagcaggggcttgcgcctcccgcaggcctagctgtgtgggatctcatggcactctgcttttattctgtttgctccaataccttctgcttgccacctgcgatgcttattttccatttccagtggtgctgtaagacttcctttcaaaatataatcacttaagttaaaaaagcccattcgaagaaagccctcgagtaaacaatagtggagcaggtgggcaggtggagctggcccttggccggtgtgtgggctgggggcaagtgggaagggacaacgtgggaaggaaaggggagcagggggtgtggggaccctccctgggaaactcccagcccgccctggcctctgttactgcctggccctgctgagctccctgggctgctgtctggtggccaacactggcgttggctgcccacatgccatggggtctgcacacagcaggggctgggggacagcgtcacaggaggaggaaggccacctgtcacaggagaaggaagggcacacagaggcttgtctgagccccacgtgaggattaacagaggggatgcattgcagtaaagagcacgaagctgctgtgacctttgcctctgaccgccccccttgcagggccacgcctgcacgtagcctctgggcaggtgccatggggtctgccaaggctggcattggctgcccagatgctgtcctgccctgaggttccatagtcctccggccactgtggcctcacactgtgtccagctatgctttttatttacctgttaacctcccagcatacttattcatgataacagtgacagggaatggggcgaaagtctgaagtgtccttcaccagcaaggggctggtggaaaagtgggactcctgtctgaggccactctgggtggtgtctgtgtcccaggactctacagccaaacccaatgcagctgggggccttccatccacagacccacatgagcagtggtaaggacctgctatattgagccagctcctcacacacgccctcttcccagagggtaaactgaggcccaggatgttgcctcttgcctgaggctgcatggctgggtggagccaggccctgacctctttgcttcttcacctgcccagggcaggtgtttggatgttgagtcgactgatgccccagggcgccaggccctccttccatctcacggtccctgcccctgaggcccgtgtgttggggctgggtggaggtggccctgtctcctttccaggtgagtggtgcgcaccctggtgagcaaggaccccaggccctggctgcagggcctccctgtggctggaggtgtcttccacacggccagtgtccggcacgagcactctggggtcggacacttgagatgggctggaaggagggggcatagagccttgcacagacaggggcagctcaggcctgggtttgaatcctgacctaggcaccctgtggtgaggacagccacaggctgaggacactggtgtccagcatgtgcccagctgtcacctccaccctgggtttggcatggggctggcagcaggcccaggagggatgggagtcagagtgtcagggaagcagtgggaactcgggacactctgctgctccatgggaacagcattggccctgtggtgtgggcagcctcagcaactgggcaggggctgtcagagcccaggggatgctcccagaaagtgggatgggagcccagagcccacagcccctgatatcactcagcctgggagcaggcccactgcctccaccgtgcagacgaggaaactgaggagggcccttgggtcccctgcccaggcctcacagagagcaggtgacagctggagccaccccaggcttgtccacccccctgaagggatccccaggtgcccaccctcttcctgccatctgggggcatgactcctactgctgacttgagagtgaagctaccgccaccgcctccctccacacctgggccagcctgggccatgccaggggcatgcctgcttctggccccatgggcctactggtcttgaccattaaaaagcatgtgttggggctgggcgcggtggctcacacctgtaatcccagcattttgggaggccgaggcaggcagatcatttgagttcaggaatttgagaccagcctggccaataggaagaaaccccgtctttactaaaaatacaaaaattagctgggcctggtgcctcccacctgtagtccagctacttgggaggttgaggcaggagaatcgcttgaacctgggaggtggaggttgcagtgagccgagactgcgccattgcactccagcctgggcgacaaagtgagactctgtctcaaacaaacaaacaaacaaacaaacaaaaaagcacgtattgggactacagtcaatgataatttattgtgcatttaaaaataactaaaagaggctgggcacagtggctcacgcctgtaatcccagcgctttgggaggccgaggtgggcggatcatgaggtcatgagaacgagaccaacctggctaacacagtgaaaccctgtctctactaaaaaaaaaaaaaaaaaaaaaaaaaaaaaaaaaaaaaattagctaggcttggtggcaggcacctgtagtcccagctactccagaggctgaggcaggagaatggtgtgaacctgggagatagagcttgcagtgagccaagatggagccactgcactccagtctgggcgacagagcaagactccatctcaaaaaaacaacaaaaaacaaacagacagaaaactaaaagagtataattggggtgtttgtaacacaaagaaatgatgaatgcttgagataatggacaccccatttcccctgatgtgacactaaccattgtatgcctgtatcaacatatctcatgtaccccgtatctcatgtaccccatagatatacccacctactatggtcccacagaaaaggcatgtattggggccaggcccaatggctcacacctataatcccagcactggtttgggaggccgaggcaggaggatcacttgaggccaggagttcaaaaccagcctggacaacatagcgagacccccatctctaccaaaaacaaacaaaacaaaaaaacttagccaggtattgtggtctgcacctatagtcccagctacttgggaggctgaggcaggattgtttaagtccaggagtttgaggccacagtgaggtatggttacaccatgggtgacagagcaagactatttctctaaaaaacaaacaaaaaacaaaaacaaaacacaaaaaagcatgtgttttcctgttctcccaccaccccacggcaaagacagtactggctattgacacaaaaggtgtgaaacgcccacatgctaaggaagacagaagcccccagaatccaacctgggggtgtttcagaagtgctgaaagggaacagtgtggtccctttaaatgatacgaaagagaggaagggggctgggcgcggtggctcacgcctgcaatcccagcactttgggagcctgaggcgggcggatcacctgacgtcaggagttcgagaccagcctggccaacatggtgaaaccctgtctctaataaaaatatgaaaattagccgggcgtggtggtggactcctgtaatcccagctacttgggaggctgaggcaggagaattgcttgaacctgggaggcagaagttgcagtgagccgagatcaggccattgcactccagcctgggcaacagggcaagtctccatctcaaaagaggggaaggaaagtgctgggtagaggaaggcatggtccctggctagggttccacccccatggacctaggtgaggacaggcatttcctgcccacatgttgtggcatttcccaagactacccgggcctgccatgctccatcttgtgcctataaaaacccctgagaccctagtaggcagatactctagcggctggacattgagaggagtggatcagtggaagaacgcacaagtggctggacgtcaagcggaatccacagacaggcactggcaggcctggcatttgtgaagccggctgcggcagaatgatgtggagtttggctggggcagtcgtaggagagctcaggccgcccaggggaaaatcatctcccttctggctcccccatctgctgagagctacttccattcaataaaaccttgcactcattctccaagcccacgtgtggtcagatttacacaaggcaagaaccccaggatccagaaagccctctgtccttgtgataaggcaggggtctagttgagctggttaacacaagctgcctatagatggctaaactaaaagcaccctgtaacacgcccagtggggcttcacgagctgtcaacatccacccctagacactgccgtggggtcaacaccccacaacttgcccgtctgtatgctcccccagaggtttgagcagcagggcaccgaagaagtgagccacacccccattgcatgccctgcgaaggggacaaaggaacttttcctgtttcaggggaatggtcctcactgcctcctccagattttctgccctgagttgtgaggacagcacagcttgggctctgtccacagcttttactgggagcctgaggctccgtcactcactcggctgctttttcctgtgctggatgaagcccaggagctggctgtgcaggtgtgtctgggatttcatgggcatagatgactccaggacagctccttaaacaccaagctcaagcaggtattgccagctaaatgaggtcaattcctggcagtggatctcagggcgccggccttggaccccacctgcttgcccacccccagcaggcagagacctttctagaaggtcacagatgctgctgcgggatggatcgggtcccaaccctggctgggagtgatgcccgacaagctgctgtaattctcaattctgctccggaggccttggagatgctgcaggcgggcaggtggggttgggggtcagcgtcacaggaggggaaggccacccatgggggcacataggggctagtgtgagccctgcatgaggattaacagggcatgcattgcaatacagagcacgaagctgctgtgaccttcccctctgatcgctgtcacagggcctagcctgcacgtagcctcctgggcaggcacacccctggacccctccctggtgctctgctggaggccacgctgggctctggaatcttactgcacagagctcctggagacccaccctcaacccttgggccccctcttccttcctgggtcctggagggggctgttagggggcatgaggccacgcagcccttgagcacctactgtgtgcaagggcctggcgtttgtgaagcaggctgcggccatcctgggtgggagtcagggaatgggggtcccggaagtgctggcttttctggtggctgtgggggatcagggggccttgctgtgtatctgtgagctgagccatcctctgaggggctgagcgctggcaggaacctatcacgtttcccaggggcagggttgggcatgagaagccctatcctgcctctcagctaggccatgtttcataccccacagatgctttggaggtgacagatctgggtcaagactggccttcctggtgaccagccttcagatggacactgggcggcaggtgttcctgggctgccatggctggtctcctgtgctggtccccagagcagccttcctctcccctccccagacaccccatcctctgccgaggcctgtgagcacctgctgtgtgcccaccttttgcttaaaccccaggacggccttacccagatggggagccttggttggattgaaggggcttgctggaggtgcagggggaggggaggtcagagcccacatgcatcctgagctccctcatcttccacaccccatgctcatccccccaacctggccccgatgctatcagcccttagctgggggagggcggaccccggggacctcagaggcagggctcctgcaagcactttgctgcacatgtctctgttcctgaaaatgccccaaccccaccagggcagcaggcagcagggtctgtgggaaagtcaggagccccgctgatggtcctgaggggccaccccagcctcaggaggaggacctgcccttctcagggccctgctgttgctccttcagctcgcctcctccatgctggcctccgggctgctcacacgaggattagaggcaggaatgaagaaaaccaaagtcagaccactaccaggaccagggtacaagagaccaggcctggacaccacttatggctgggggccttgggctggtcagcgcctccccctcaaggcatatacacagtggatcggtaaaggctgtcccatctggggctgtgtcaggcctctgtgggaggaggcatgtggcgggcccagctcagttgatggattcagacccatgcatttggccagccctagtcagggaacattgcagccactgcctgcccagcactgggcaggaggaagtgtcctttctaagagtggagggagctcctgctctcaggcctcagaaacgaggtgctaagggggctttcaggcagcagcctcaggcaggaggagctcccgtgccatgcgaatggctttgcccagacaccgggtggctcaggcaggtcactctgccttctgtgtcctcctccttggtgggctggtgggctgagccaggagtcgggcttggggcctgttccaggcttgcaggcaggaacaggcccgggacaccccagagacaatattgatgctgtttctgcccaaacaaatgccagctactaattccggtctctgttggaaacacagaaatcaatgctcacagaacagggaggctggccctcgaggagcagtgtggtgttgggtccccaggcagtgattacgacaggacaggcaggcaggagaacagagctctcgaccttagacacgtcccatgcggccctcacctggcgacctggactcggcagcacgttgggggtcagaacagtgggttctcagggacctggcctcggggggcacccgtcatccctcagcaccctcccctgcaaaagggaagcagggcctggacatgacccccaaccctggctcctgccacattcccctgactttatttaccacccgagagactcataaataatagttgaggggtcagtgagcgaatgaactagccaaaaaaccagctggggaatgcgtgtgcaggtggagagaatgggcgctgggcctgcctgggcacaggttcacgggcctctggatgcagctcaccccgtgggagcccacagccctgcaggccgggcagcctgagggccaggacagccccacccttctctcaaggtgctggtccagggcctgtttccccatccatgtagcattcttgatctctgggtcctaccacgtcccttggatctcaggctcccagccaggaggggctcccaccaccatctcatgaccttctgaaaccccagcgctgggtgtgcaccttcttgccaggctccatgggcagcaagcacccgcccctggcctgctgggcactgcacccaggaggtgcccagtacttgctgggacagctgtcttctgctatgtcctgggctcgtgtcctgcctgcagcttccgggctggggagcttgggcaaggctcttggcctcccccacccccaccttggtatccctcaacccatccccctggacatggggttggtgcctctattggaggaggtggtaggtcaggcagcctctggcccgcaaagtcggccctgggtccaccagccgcccctctgccctgcctttcccgggtcccgccttccctttctagggctatggctgcttgtggacaagcgtctcacgggtaggaaacgggacctctgagagctcctggcctggctgggtcctcagcatgtgggtctgtgagccaggtccacgccaggcaagggtttttacctctctgagcctcggtttcctcgtctgtaaaaatcagtgaggggatgtctccttgttgcacacacagcaggactgagattagagccacagcctgccccaccccagcccctggtcaggtgggggtgctgccatctcccagcagcctgcccaggcccctccctcacctgttccgagacttcctggccccacatgggcacccggcatccttgtgggctcaccacagcctgatgctgcccacagcccatctgtgtggcctggcagggggccccacagcttggaaatgccggtatctccttgcagaccccaggtcaacactgtagattcctccctcttctgtcatggaccccaggaaggagggtgggtggggccctgggctggtgcaccgccccagaagccctcagctcctggcaggacccccctccccctgcaggccctcccctgggagcagctgcttccctgttcattccaggctgggtggggacccccaggatggccctttctctgctgtctgtgggcctagggtggggtggccctggccaggccctgtatggcctcccaggcttccccttcacccactcgttgtgggcatgtgacacattcattctaactacaaactgacacccactcactgagggcattgaaaaaccggagagccccaggagccaggtcacgtggtgaccccgacagagacaccccacaagggtgtcccagccaggtagagtggccctgggttggggaggcttttaggttggatgcttggttaggcacctgccaggtgaacctcagctgggggcagagaacctggggccaaaatctgggggccgtggtcctggggcgcttccctgggccccactgcaggcacatgccctcccaccacgcgggggagctccccctgcccgtgagccctgcttgcacttcctcacccgtcctcaccctgccccagcctccagcccgccctggagcaggctctgtccctcaggccctcttggccatggggtcagcctggtgcctgctattttgccctcaggacccctttctcctgacccctgccaggagccctcagcattcactgagttttggaggagctccctaaacacagctgtgttcactctggaaggctgagatgtgggggcaggtgcgggtggggtaatgatgttgggtgggctggcagtggagccagagaaggccctcccaggacgagggcgcagggggctggaggggagggcactcgggccctgcttgagattgaactcagttactgagcagccagtctgccaaagtctgatctcccggctttcattctacattaaaaattgatctgagatgggagaagtgaaggcagtggccatgccaccgagaaacactagctgttctctgaggctgctggagacacagcctcctccaggaaggctcccagaggcagctccagaccaccaggcccgcttcctccatgctcatctgccccacgcttgcctcagactcctggcagatcactaacccctctgagcccccagccaggcctggatgggtttgtgtttgcatgaggaggccctggtcctcacaggctccccctgtagccagggcagtccatctcatcctcacccccgtccactctgccggggctcctctgtccctgagttctgcctgaggggctgaaccaccagcctcggggcgggggaagcccactgcacaccacctccctgacatcccgggacatcttgcagagaaggaaactgaggcttaagagaggaaacagtgtctgcacagggcacaaagccacagagccgccttctgcacagctcccacctgcacctgcgtctccaggggagctgggattttccaggagtaggtcctcaactcttgggcatgtggctgggcccttcccgaccctcagaggagagcaggagccacgggacaggagtagacatgaagaagcctccacagggttgggcttgcccagggcagcctgtggccagcgctgggggtcacggccccagtggccttccgagggaatggacaggtctgccccatctctcgccttggctcaggctctgtgtgtgctcactcaatgcagccgccagctgctgctcccccacggggtctcgctcactgcatgcgggctctgctgctgctgtcggtccttggccttgagaattcctctctgggaatgcgtgtttctctctgtgaacatgttttgccttctacaggcctccttagcctcatcagagactcctgaaatgagtttcccggtcctgtgtgggccaggggccacccgcctctccagacccccagggcccatagtggcctgtccttttgtcctgcggcctcgggcccctggggtgtgtgggggggtttcctgtccttcccctgagccctggggcacggggacccctgggtggatgcccctcatcctcatccagtgcgcttgctgccggccccaggccccccgcgaggggccctatggagtcgagacaggagcccacctataggccctgtgtggcctggaaggtggggatgccaggggagctctcctgcaacacccctgacttccagactcccctgagggagggacttccacagggaaattaaccccggacgagcttggttcccaggaactcacttcgagcctccaggaaacaaacagccccagagggcaggacactcggtgtccgaggcacaggagtgagcagggtctcctgggcaccggtgacctccaccagctcatcctttgtccacacctgggtgggctgtccctggcgggctctcagggtagaggcgggggctgggtgggggcagagcaggtgcagaggctggtgaggcctgctgggtgggaggtgggggtgaccgctctctggctgccttgactccattcatcagcctgcagacccccctctccaacccccagtctttgaagccacaataaatattgatttgggcaaatcgatgcatttccgagggcctgggtcgatagcaaagttacaaggatccgggcaaagtcattcacgtgcccaactccagctctgagaagagcctggctagagctaaaaggtgactggccatgtcccgggtgccagtgccaccagctgggctaccccaagggatgggcagtgtggcccctcactctcacctggccacagccaagctggggttgaccgtcagagtccggctgcctgtctctgcgtctccccgtgtctgccccctgcccagctcctggctgcatggctgcctctccccgtcctgtctgggtgtcttcccgcctggatcccagacactcttatggggcgcttggcactgggatctgagcagttctgcacatggtaaccacgggtccagggtagagctgagggccctcatgcgacgcctccctcgggctctcacagtggcccctgcccctagatgggaactcattgcttcctaagctgcctcttccatctccacccgcagcagtgcctcaccctgaccctgggccacagaggggacatctccccaaatgcacacaccagccttggcctgcttaaggtcacctggccatctccccgctctggcctcagcctctgtgtttctgctgtcttctctgactccccgtggggtctgtggagacctgaccactgcggccccacctgggtgctgtttcgcacgtggctccctctgctctgtccaccgtccacagttcagcccttcatccaagccccccaagtgcctgaactgccctctctagagggcaaggctggggcccaggaccctgggaggaggtgcctgtcctctgagtcctcctaagccagaggctgggcagggatgcgctcaagggcggtgggcatctgggctgagccctgcaccctcttttctcctgacatcccttgcctccccccaccccgcctggtctccctccctctctaatcatttctcatggctccaacccactctgcctttcttcctctcctcgaactacaaggctgggtctggtgcactctggtggggccaccttatttatgagaatttgggaaatgcagatgtgatgtttccagctaatagccccaaatcacttgcaccgccccattagcggggaaaccagcctgtgtacattacataccacctaagtgggagccgagacagcggttttatgaccccataaaactttgggagtttattgctattgaacaaacatgtaatccgatgcttcaagttcaatatatatagccagcagcatctagagccaaccatggccgtggctcctacagctgggccaagctgctgagacatctaggggatttggagccgattggcaattgatctgctgtaggacaggggcaggatttatggtggccttgcagggctggtccttctgcatactaaacagtccagaggacagcaaggggagggcagccgcctggagcccagggcaagtggctgcttgtgggttgctggggcagagcctttagcaaaggggtatccaccttgaggacctgcccctgtaaaaacccagcttccttggagactcagctgcggtgggagccatgcagaaagtggccctgtggctgtgtgccctgcccttcaagaggcaccattgcctcctgaagcctgtttccttgtctgcaagatgtcccaggatggtttgttgcccaagaggtggcccagcagagctcctggaaggaaggggcaaacacacaggccagagcagcggtcaaatggctaagccttatccaccagagcccctcacccagctcccattcatccactgtccaccatccattcatctaaacacccatctatctaaccatccatccttctacccattgatcctttcacccatccacctgccactgatttatccatccatccctccacccatatacctatccatccatccatccatccatccatcctttcattcatccatccacctgcccatccacctgctcacccatccattcatgtgtccatccatctatccatccatttactcacctgtccatctctctattcatccactcactcatccatgcatctatccacccatctgctagtccatctgctcatccgtccatccactcatctatccattcatccatccctcccaccattcattcctctatttgtccacctgtccacctaccattcatccacatagccatctctctatgcacccatctgttcatcccccatctactcacccatccattttcacctactcactgtccatccacccacctgtccattcacccacctatctgcccatatacttgtgtgtctgttcactcattcattcaccctccattcatctgcccatatacttgtatgtctgttcactcattcattcaccctccatccatctgcccatctggccttctatcctttccctcaaagctgccccttgtccagggacagggctgtccttatagtcgcagagatgattggagcctgagagagccaaggtgacttatctcaccttgcagaaggtgctggcattattgcttgctcaggacacccgcatcctcttgccctgggcttcacactccaggaatgcctttctcatgtctgtgctgcatatacttattgtaagtaaaggagaacctcatggccgatgatagtttgttcatttcctcccagtcttattgtgtgcacctattctttcttccaagttcacagtctctctgggcttgtatggcgtgcatttcactcaccacagatgtctcttcggggctggtccatggtgttactctcccagcattgacttaaacatttccccactgttggatagtgtagctgtttccacctctttgtggttataaatatgctgtggtcattatctgagctggcagagtgaagtccgcccctctacgtgtttaattagcatagactccaagagggggcattcatgggttaagcatctcatgacttgggacaccccttgtccgatgacaaaaacctggccctgtgatccctgccctcagtggaggagggagggccttccgtggtgcccggccggaggggctgggatgtgttcactgtgagtctggtgggtctcacatgtaggcagagtggggacaaggcagcctgctctgtggcgtgtcccatggcgtccgggttgccttgtctgcagttcactcacattgcccttggtgttgctgcttcagataagttcctgccgtgttaatgctattaattttttgtcatgttagtgtcaaaaatttacccgcctcatttcttgtcttttagcttgatgttttcctttgagccacctgagaatttagcttccacacagtcaaagtgaactcatccttccctttattcttggaaagttccttctcaccagggattcggtaaatatttgcttctgtttacttcctgttcctttcaatggtttaagttattttctgtcagcatcaacttattccccagcccatatccgcaggcctcacactctaattaagaggatgccctatggccgggcgcggtggctcacgcctgtaatcccagcactttaggagcccgaggcaggctgatcacttgaggtcaggagttggagaccagcctggccaacatggtgaaaccccgtctctactaaaaatacaaaaattagccgggcatggtggtgtgtgcctgtgatcccagctactcaggaggctgaggtaggagaattgcttgaacctgggaggtggagattgcagggagccgagatcatgccatcgcactccagcctgggcaacagagtgagactctgtctcaaaaaaaaaaaaaaagtaaaaaataagaggacaccctgtgtccctccctctctccctccctacccttccttccttccttccttccttccttccttccttccttccctcttccctccctccctccctcccttccttcctccctttctgcctaaacttttctcaatagcctcaaggctgcaaataagacctgcccctggcctcagtgacttggtggcacagacgtgcaaagcacagaacgcagaaattcaagtcagggctgaggactgggggtggatgggggcctgctggggggctgggggagagagtggcagggtgagctggggacattggaaaactcttgcagctgtgactgatgatggtgggcaggtgtaaggggtggcttttcgggggaggcacattttggcactgggttatgtgcttcagcaccaggagcaggggtgaggtagcagacggaggggaggaggccatacacctgggcaggggctggatgggactggctgacagctgacctccctcctgtgcccagagagccacagcctgctcggtggcccgcatgggatgaaacctttgtggtcccagcttctgatcactggaggtgagaactagtttttgagagacgggagcaactgctgaagacccaggggctggggcacggcccagcgtttgcttttgagagcttcgccatggcccgtgtggagaggacagcaaccaccagggagggggctgggtgccccagcctgtctgccagcttctgagccccacctgcgtctgcacctactggagacagctgggtgggctctaacctggatggtcctgggtgggaatcccagctctgcctcatgtgagatgagggctgagcctctgctcatcttagaacctcagttttgtcacccatacaatgggatggtcagttagcaaggaaacgcgtgtaggtgccccgtgtagtgccggctgcctgggaggcgctcccagaatgtttcagaggtgattcttctcaaggacttcctgggccccttggtcataaggctctgaattcccagcctctggcctgagtgccacagaccctagagggttcctggccactcctggggtctgtgtggacctcgctgcttaaggccccccgtgtgcactgaagcgcgacaccccgcacgcaggggccatcaggtctttggggattgatagaattaagcccatggaacgtgcatttgcttgctgtgaagccgcaacaatctcgctgccacagggcagaggacgttctgaactgagtgtcccctcggctccctcaccggcctcctgcaccagcagatggtgcctgatgtggtggctggcactggtgccccttgccctctgagcagcggtaccatcaaaacccatcttcccagcagctcaggatcaccgcggtggagtttccagtcgcagatgcccttggcaggggctgtgggactgcaggggagacggaggtctgggccctaccatgtgggggcagcatgcaggaggggcccattcctgccccccggcaatacaagaagcctacgggggtgcccaggggtcagggacctgagagatgtgctcactgagacctagcatgctcacccccagctgccagagggggtagttcccaaagaggggcaggccctcagagtgagctcctgtcctgagatgggcaagggaatattcctgggacactgcagaactgttaccaagccaggcacagatggggccaggcccctcggcctctaagacaaggccggcccatggatggagcacgatggccctgaccttgggcacagacccgacgattgagtgagatggagacacaggcttggcttgtccccaagaagaaagaggcacagaagcagctacagagtttcttgcttccctgtttgggttgctgctggctcaggtaccacagctggcaacagaaacagaggtcaaggcccagagggagggaggggtcgggtctgctttgtccagggctggctggccccaggagggccccgaagctgtggcagaagcaggtaccagatggtcagtgtagcactgtggctagcacccaaaactggacatgggctgggagcagcctgagatgcagggcagaggacagcaagccacgagtctgaatggcccctgttctggaggcagtgctgggaggtggaggctggagggggtgtctcgcagagcctggtctgctgagacataggctgggacaggctgctgggtgtactgtccctgggaagtgcaaggtggcgagtcaggaaggccccaggagcagggttggggcaggagccagtgagcagggcaggaccctcatctggaggggctgggggaggtctccagtctgggatgggggtgttcccggcaccagcccagtgtttctggtgcagcagccacgtcattatggttggaatgtgaccccattagccctggggcggggctgttcaacatcctgaggataattgatcagagggaggaggggctgcaccgcttcctagcaggttgagttaattatcagcctgcattagcacttgacctgtggcatgtgtcaactcattactgctaattgcagggactcagtgacctctccgaacttctgtcacccctgtcacggcccctgccctgtggaggcctgtggaatgggaagtggggaggggaaggagaagggggcggagtcagccggagcctcctggccaggcctggagtcaccctgtcctgccacagctctcatgggtttagagtgggccctggggcagagggtttgcaaggataggggtgggtggctctgccgagggcggtgttctgagtaggtctcattccccagtctgcccagcctggccccaccccagctctgctgccctgttactttgtccccctgtgttcaccctccacttcctgccggggacactccaaggcctgccaaggttggagcaggggtgggactcagccattcaacaaacgcttccttggttatgcagggctgggcattggggtggggggctgacctggaccctccaagacatcagattgtccaactgctcagttttcattggggcaagtgcctcgctgagggtgaagggggctgtgagtgcccatcagggagcctggacaggtcccgcctctcacagctgtcccactctctggagctgccttggtggcagatggcactgtcctagaaaggtgaggctggagctgtctcttccaccaggggtggccaaggacgcttccagggtcttccatgcaggcctccagggtcaccctgggcgtggctgagggcatgcagaccacgctgtgctcccccccaccccccatgcccgtcgcttgcctgacatgctcctcagctgtcttgccccgcagaagctgtgtggtctcccctgtgagtagagtcgggctccatgatcctccggagcagcgccagggactctccccaggcacaattttaaagggggccctaggacctgccaggtccacggaagtggtccttgtaactctctccctggtggcagcctctggtgcattccggcaggggcagcccctcctcatcacagggaccctgtgtgccaggccccagctgcgttgccgctgaattatggatttaatagcagagaagccttgcaggccgcctgtgctggctcgggaaaccggggcccagccggggcctgtcacggtcctggtgccgccctgcttcctgtcggcgccacggagcaagcggagagatttatcttcccggctttaagaggtactaacggaggaggctgagaggcaggagctgaataattgatggccttctctggctcaggatctgctgaaaatgacacggtgcaaggcagaggggctgagagtgctgaccacaaaatgctgagaagccactccagggcggtcacggccagaaggaggacccccactcaggacggggtcacaggcatttggggcgggtgtcagaggctcctgccctgggtcattccagggggccaggatacccagaagctgggcctagaggcccacagggctggctcacccccacttccctctcacacgcctgccatcaccggtgcttcagcccagcaaccccatggctcgttggccccgtccacagcccccactgcctcctgtgtgctgggcgtgggcctctgagctctactctcagcctccttagccccaggagaggagtggaggacaggggtttaacgtggggtgtggtgcggagcggggagggctgtggcgccccctcagcccctcctttcctaacagcctcagcctcccccctggagaatcccctacctgctgggcacatctggcctctccccaccattctgtctccagccgggagatctctacccagtgaaacagtgaaacaggaagggttccctggttaccccgcgcagggcgcagggcatgcagcgggggagtggctcgcttcttcagtgccccaccgctcacacctctaggggagcatacagacgggcaggctgtggggctctgaccccatggcagtgtctgggggtgaatgtttacagctcttgaaaccccagtgggagtgcgttaccgggtggtcttttagtctagcggtctgtaggtggctggtgagagtgagctcaattagacccctgccttataacaaggacagaggaatttctgtatcccagggtttcttgccttggtgtaccaaaaaattggatcacacgtgggcttggagaatgagtgcaaggttttattgagtggaagtagctctcagcagatgggggagccagaggggagatggttttcccctggagtcaggcaacattctcgggatgtccagcagcttgtcttcttccaccagtgtgttcctctccccacacagaggcttctgtctctgccttgctagggtcttgggtttttataggcataggatggaggcatggcaggccagggtggtcttgggaaatgcaacatttgggcaggaaatgcctgtcctcacctaggttcgtgggggtggagccctaggcagggaccacgcccttctctacggagcacttcccgtccctcctctgtatcatttaaagggaccacgcttttcccttctcagcacttcctttccgtatcaacaggaggccagggactggctggacccctaggagccaggtcctacggataggtgagccggccccccagggcaaacacctccactgggcagacctgactgcccagagctggattctttacttgtaaaaggggccatgagtgacacaggctcggcctgctgtgccttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggtgacctcgtgtcggcaccacgcccttctcccatgggcagtcctgggcgccccttcctggccttgggcccagtggcctgtggcctgaccccgtccactcctgcttggttgtcccagcagcagcaggagcccatgctggagaaggtgttatggggcaggtggagggcccggctgactcagatgatcccccaagtttcttttcaatgaacacttgtttagtgcagtttttcctcctcaaatccccctcacacaggcagacaccctcttggcccagggtaatctgctgagcctttgctcaaatatagcagctttgctgctttctaaacacaactaatccaatttgggatttggggattcgaggtgggcagcactgggcctcagatgagcccccatcaccccagacccatgcaggaagagccaggcagggtggggccctggggccacctggtgggctcagggccagggcatcgcgatgtccccatccttcacactacggggcttcctggctgcagagttggggactcagctgggaatgctggccatagaggcagagagcccccatcctgctgggccagccctgacctggcttctccagggtggcccagtgtccccttctgcccttcccctggctcccaccgtccacatccctctatctgcccaccctggacaacaaccagcacagtgcagtgtggccctgcagtgacaccacctgcagagaggtcaggcccagcctcccccgtctcctaaaaggccagcaggtcccaggagctgggggtggggcctggctgtggggcctccatgccccaggggccagggcagaccctccttagccggcaaccactgcagattcctcccctggccagcactcggggacctccctgcccctgccccgtccccctaccttgcctgctgagacatagggctccacgggtctctctcctggggccgggctgactgtggcctgcgaggggcagtcatcgtgttgggttttcctgccagaggcagaaaccacaaaattacctggaacatacacgccccaagtgacagattcaattcaattccacaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagcacggggacatttatcagaaatggaactgatggattaaagtggaaccaagcgaattgatttttctccctgggcactgaaatgctgcgcttaatcaagcgatcaactccgtgggcagggtggctgtggggacggaggtgggggacaaggggatggtggccatggtggggactgaaaggtggctatggggacagatgaggtgagccaggtggccctggggtcgagctccagcccagcctctggcaaagaggccctgtgtgcagaagtccgggtgtgatgccctccccccaccgattgtgtgataccggccagtcctgtcccggctgagcctcggtggccttgatgtaaccctgtggggtctggtggcagggactgattcactcatttgctcattcattcatgtgtttgacacacactgcagcaaaggaaaggtgagagcagccacaggctggccagggacgattcagacttcagagtgtagcgtgcccgcccctcctcttgtgaggtccagccttggtgtgtgtggattcccaggcaccctccaggtccaccctccactctgcagtgccccgcccacctgtccacatactctgttctgtggtttgatcgccatccttctgctctgcggccaactggatggcccaagcggactgagttgggcagggtggtcatacctgtggagcctgtggctgtggttggaggccccgtgggcagctgaggcagcctgggtgggcatgtcccactgggacttaagcccctaggtgggctgtccgaagtgactcctgagtggctggggtgtgctgtccttccagcctggccgtggtggctgggtggtgttggaaggcactgaaggaagggcaggtgaattcgtgctggacctggtctcagtgccatgggccccaggagcccatgacatcactggcctcatggactgtggggattaaccctgtcactggacacccccaacacaccccctccaaaagaaaggtgttggcacaagtgaaaccccttgagtgatggctgggatttcaagctccagactggtccccactaggaagctctgggtctggctggtggagcaatgtgtacccgcgcctctgcgtctccctgcatctggcagccctcccaacagggctcatgtggggtgcagtgaagcagcaaagccccccaccccaccccaccccagactaaacacaggctgtagacctggcccagggtgagaagggcccctgtggaccacctacccaggtggtctgtggcagcctctcccagctttcggtccaggtggcccagggaggtggcagccctgacccttcctggcgataccctgattgatcatagtgaaacactgagctgggagagccaggggcacccagggctgagctcccggggcagctcccaggagctgcaagtggacctggcactaggaaggagcagtccaccgagcacctaggccagggcccgggacggtgccaggcaccagctgaggccctgccaggccagccgcatcttcacattcaagaccccaggccccagccacggctctgagctctgggtgtctgcagccacggttggcagggtgggccccaccttgccctgactgggccacggactggtgtgaagagctctaaatttcacttactcccccaaagtagaagtggcctaggactgtgtggtggctcctggtctccagaaccctgccaggctccagggcaagcagggaagtcaggcttagctgcagggcagcacctgtctgcacaccccgtcctgccacgctccctgcagggacctccgcctgttgtccatggtccagcttgctggatggggcagcagctcctacactcagagctctgccatccccagccccaggccaggctctccccacagcccgttaggccctgacgtcccctgacaaccaggagttggacaggcctggcccccaggctgccccacactgccatgaggaccccagctggctgagtcccatgtccaggctcacttcctctgtccctgcagcagtgagcacctgggaccatcatggtgagcaccacccaccttgccccttggcccatactcggggacctgggttccccaggtgatcagggtggcctgcagggcctgaggtggccatgccagccaaactccccctgccccacaactgggtcacctcttcaccctcccgcagcccttgggaacccagtgagctcctcccccttgctgctttgtgagtgctggcagtcctgggttgctgtcctggagctccaagacctcccttctggaaggctggggcttcctggtggaagatcccgctcacctcagctgtggcgtgggcctgggcttcagcctggggcagccctcatgggcaactgcttcagactggaccccatgtgctggggtggccagggctgtgcatggcaggttcagggcacagggtgcaggcaagggtgtgagggtgtgggagggcttcagtgggaggccctgatgctgagcagacacagtacagcctggtaaacaaggctcgtgtgctgggcactcatcgatcttggccattcgggcctggccaacagccggtgggctcaggcctgggcgggggctggggtgggagtgagctgcctcaggctgggccgtgggcactgcaggtggcttgtccggacagccctttccctggacccctcatgcccatggctctagctgaaaacacagctgctcttctctacaggctcgtcctggggtgaggagggtgtgggagctgcctagcccttcctttcccaaggggttgggtgcccctggctgaggaggagaccctcatggctggaacttggtggtggtcagagcctcctggaagttgaccagctgagctccagcaagtccatgcctcctgggacacagcctggccccgatgaaccctcagctgccatcatcctcaaagtcgcagcaggctggatgctgaaggcacagggggccgcatggactgtggctgcagctctctcattgtcatggggagggaatggcctgcagccccatcttgttcccttctcttaacagcctctttccaaagatggcccgagctcccatccccgcccccacagggctcttcctgcacttccccaggcatcctgggaggagaggtgggctgtggctggaatgtgccgccctctcaccctcctgccaggaccactgtgctggctgccttggtggcctggaggcctgcagagctgcccaagcgggggctccatgcgcagctcccactccatgttctgtccctggggaggcccacacagcactgcccctctgtctcattccaggtgcctggtccccagcgatccgccttgaccccagatgctcagacttgctagcccagggccagaggggcacaggacagggctttggagagggggcttcctaggctggtgctggcccagcctgcccagccctgccctgctcggcccctgcctgtctgggtgctggacctggcctgatccatgaagcttctcctagcgaggtgttttccaggcctttggaatcttagggatgatttcgtatggggaggggccttctccccagcctgctgtcttatttttgtgccgattccccgcagcccgagctcctgcccccagcacctgcctttccagcctgtgtcctgtcttccaccagcggactccagcctggctcccactgccacgtggctgcctggcgcatgctccaccccgtgtcctcccagggtcccagtgagggcccagccccgcagtgcgcagtctccgcagccatcgagtaggcggccagctgagcagaggtgctggccggctgccagcccagcacccgtcctgctgaagttgctcctggcacgcttccggccccaggcttccctgggtggtggggcagactttgtgttgctggtgtgcaggaagggcccacgacccccacccaacatgtgagaggggcatttggcagccatgggcaggacaccaccttcgaccatcagctaggggtatgtgcaaagggcctgagtgagaaacaaaagacaaaatggaccaaatgtgcttgtgtggccgggtgtgtgaattgtgtgcaggtgagtgtggaaagatgtgtgagcacaagcctgtcagcatacacgtgtgggcgtgggcatgtgggtgagcatgcaagtgtgtatacataagtgagtgagcacgtgtgtgtggacgtgcatgttatgtggatgtgcatgtgtgcatatgagtgtgtgagtgcatgtttgatgagcatgtatgtgtgggcacacgtgtgtgtgtcagcgtgtgctgactgccatggacgtgcacctggctgagtgtggaaatgtgtgtgtgagtgtactggcagtccaggttttacacccacacggctttgcctccccaggaatccgttttaatagcagagtgggctggaagggctggccaggccctgaggcagttttcaggccagcagtccctggctcctcatatgcggtgacagcccaggaggccggggccctcagagtgcagtctttggacatgcctggttgatggatccgtcattaccagcctgggagctgggcatgggctccggggctggaggacacccctttccatccctggccctggcgagcccggccctcctctcgccccgtgataacctgcagcctcatggggaaaggcacgcggaggtggtgccgcacccccagccctcacccctgctttgccaatcctggatcctggcctccgcccgccaaagtccaccattggccacaggatgtgggtgctgtgctgtgtccttgaaaatctgaagatgaggacagctcagtgggcgggggcgtttcacacattcgacacatgccctcacgcctgtgggtgtgtggcgggctggtttacagttacgtgaggatttcagacccaaagtgcagagcctgcagctgagcagtgcccagggagggctggggaggaaggtcccagccaggaaagtagggtgactctcatcagtggctgcggtgtccagctgggatgatcagggccgtgccagcctggtgcgcctgggggacccacagcagaggtcctgcatgcacttggctggcacgtgtagttctgaaggcccctggggaggcctggcacatgcagtgtttggggaccctctctgctgcctagacactgccacagaccccacacccaaccttgctgtttttcccccaagtgaggggagctgctttttccaactcggatagcccccctgcactgtgcagctcgcccacctccctcacagctattccagcatctctgggcgggtgcgggaagccggatgcagccagtaccgttgctgtttttggaaaagagaggttcaaggcagggagggcccagcctatgttccagcagggttgtctggctgggggggtctgcacctcgcccctgcacccccaggttcctggctccccacccccgtgcacgaagcccttcttgcctggcaggcctgggggcccccggccgccatgcgccccaccgcgggtgtgatttggcagcagcgttctcctcgccagcttgtttctcacataggggatgtttccatttttacagcagaaagaaaccgattccaagcgcctcagccacagccggagcgcgacggcccccagggagctgctgccacgtcaggtgctttgggggtgtgggctgctctgccagccgtggtcctaattgctgtcactcagggagccagctctagcctggggcaggcaggaaccatgaggggggtcttcggggcaggcactggtccctggcggaatccgaacctctgcctggttctcctggcaccccctccccagagacctggagcacctcccgactttgggtgggatgggcctgtggttctggaacaggagctttgcctgtgggaccctcccatgggggcggggtgtcctctcttagcccaggtgggtttgagccccacactgctccttccaccgctcagattcccgcctgcaggtccctgtcacggggctgctgaggaccgaccaaggtgactgcccatagccccacgccagcatggggcacagctgcctggcggctctgccgtcaccccccgtgctctgactctgtgctgtggatttgtgtcacctgcagacttgggtggcattgggcacaggggcacggtgtcctctgtcacttccccaccttgcttggggctggtctcccaggatgctgaagcattgaagtgcctcgaggactgttagaaagattttcttagaaagaaacatttgctacccagggcacagaacagctcctcgaggtctcgtaaaccagtgtggactcggccctgctcccgagacttggaggaaaggcagaaagggcggcaagtcacacgcaaggcaattttcaaagaaaagggcacaactcataggaggcaggggaaggattccatttcacctacagtcatggccccgcgtcttcagggaataggtgctgtctggtgcatcacattattagtgctggagggcatcgcagtcctgggggaggtcactgccagcatggcagcccataggaagtgggagggtgggattcaagggcaaggcgggtggtgggtcctggcccctgatgaggcaggtggatggtggacctgcctccaccctacccagcaggctggccaccagggcgtgtccacagactccagacaagaaggagagagtaaattgaggcatgtggggcccaggccctgggcgcaaggctggaggcctgaagtggcatcccatcagctggaatcaggattgcctcgatctttgattcttgagacaggaggagtgtggcggtggccccagcaggatccctgagatcttacacaggtgaggtggttgcagaagcactacacggggctggggcctgagggtgcagtgctgggtctaggtctccctgagagtccactgacagctgtggaaccaggcctcaggggagctgggtgcaaatcccacccctccacagagcagccgtgtgacccgaggctgttttgccctctctgcctcagtttctctctggcagccgctcctccctgggccccgacctgacccttcaggctcaggaggctgctccaggtccagaacctggtgctgcactgggtccagcctccaggcctttgctaatgttgtggtctctgcctgtgataactcctgcgagagctcctgatctcttatgaccctcccctgcctgggcagatgctcctcctgtcaccgagggtcccattagctggcagctaccctgccacttggtggacccaggtgatgtgggtgggcctcactcttcatccacaagtgggtgagaaaaggcaggaaaggaggtgaagccaaagatggcatgctccccctgcacagggtgactgtatgggggggtcacggcgggggagggaggggaggagagtggtccatctaagggccctgccagggcccaatgcaatgtcccatccttagatccatcttcagtcacatccccacgctagggggagcagcatttccaaaacgcctgccctgggggctctcagaattcaggggttccctttgaggtcacacaggccccactgaggccagacacagcaagtccttgctccttggcctaagcctgcaacccctgagcctcagtttcctgcagtaagtgggacatgatgcctttccactcctctaggcttctgcccatcctgtgtcaccgtcccagcagatgagtagctggtctggtggcctgagaccttgcttcactgggggacagggctgccatcctcgaaggccagggtctgggcctctgggccgggagctcctccatcagcttgcagccctgggggaggcttgcagccctggaggccactccctctagtgacagaacccatacctctgggaactgcttcctctgcctgcatgccccaaacttggacttggaggttgtagatggccgtggcagggcccttgcctggcccctatcctcctgcagcctggcctaggcatgggtgacttacccagtgccagcaggctgcctcagcccgtgcccactaaaaaatttgttcctggccgggcgcagtggctcacgcctgtgatcccagcactttgggaggctgaggcaggtggatcgtctgaggtcaggtgtttgagaccagcctaaccaacatggtgaaaccccgtctctactaaaaatacaaaaattagccgggcgtgatggcaggcgcctgtaatcccagctactcaggaagcttaggcaagagaatcacttgaacctgggaggcggaggttgcagtgagcggagattgcgccgctgcactccatcctggacaatagagcaagactccgtctcaaaaaaaaaaaaattgttcccatgatattccaaatacagtcatataccataatgacatttcagtcaaccatgggccgtgtatatagcggtggttccataagatgagaatactgtatttttactataccttttctatgtttagatacacaataccactgtgttacgatcccctacagtgtccaatagagtaacacgctgcacaggtgtgtagcctaggagcaaaaggccaaaccaaatagcccaggtgtgtagtgggctctgccatctatgcttgcttaagttactctatgatgtttgcacaatgacgaaatcaccaaacaatgcatttctcagaacatagccccatcatgtaatggcatgagaggacacgggcagaattcttggatgcccattttggggacagccaccatagtttggacattaatacatttgggcacatgcacatgagcacacacatgctcacatgcacatggatgcacacgtatgcgcgtaccactcactcccgggcacatgctcattcccgggcacatacacagtggggcggggcaggaaggctggatggggcccaggggagtcaggtgctgtggtgcgctggggctcaggcccttccagcattcaaacagagagtctcctaagaaagcagggagcccacagggcatgggatttggaatctgagtcagggatttgaatcccatcttgtgccctgggcatgctaagtctccctcctagtgcagtgggtgcctgctgcccaggctgcaggagcgtttgaggaggcttgtcagcctatagggaactgcctggcgtcctgctcagtgctgcaggctgcatgaggggccaattgaggaccccctaagcccaggaggggcagaggccagggaccagatgccacaagtatctgtgggtgggcttggctgtgatgagcaggacagggctcagccaatgcccaggggcagagcccccgaggcactgatgaccacagtgaggccagcgtcaggctctgggtcttgggtcttggtgctgctccaggagtggacccacatggcccctcagatgctgctctgtgactccaggcctgggtcaagccgacctctctgcttgtccccccacctccctctaggtaactaggccccaagatgtcacagcatcagaaatacagagaaaaaaaagcatagttaatactgctcctgctgggaaggcccacagcagggcggatggtagtgcacccagcaggtgtgacagcccagtctccccatctgcagggaaaccccatgccccctcaacccttactgcctgtcaccagctggaccccggtctctcctggctgctgtctcacctgccttcacatggtttctggttctttcatcttttcattataatttttgtttggagaaactttaaaagtaaaagaatgtgggccaaaaatatgttaacccattcccaccagacatgcaacactgggggggctgttcctcccaggctccttgggccccccagctgcccatgacccctgggtgtgcccagacagcagggggggtgtagtccacccccaccacgtccacagcccctgactctcgggtgggtctgggggctgctcgccctgggagagaagccatcccctcccggcggggccatctatcaggacctctctgacatcagcattttcctctgtggctctagcttcctgcctcctatctctgtcctcctgagaatgtcccatctgtcccatctttcccattagcagccctgtccttgagcccagtgcaagctccacagtggagaggccactcagcattgtaagtgaatgcttgtcctcgtgcctccctccccgggagctctgcctggagctccttcccggctccggtgaagctgcaggcagcatttcattgctttgacctgtcccagggcaccttccttctagaagggcgacttgaaaccttttcatcacagcacgacatatgcccggtcttgctttggtcatccagttttatgtgtcccattttatactcattttcttcccctcatgttttgtttttttcttttaactaaaacgatccatttattgagttaaaagattgtatattcaagacgttcactcagtatgtgatcctgcatagtaaacctcgggtgaaacaaagacaactatttttatatatttttaaaaatttagtggcatatagacttctaatattttggggggggggatattctttttttctttaattatggtaaaatatccataatataaaactgaccactcgaatcatttctaagtgagcagttcagtggcatttggcatacttacattgttgtgcagccatcacccccatccatccacagaactttttcatcttcccaaactgaaactctgtatccattaaataacaaatccccacccttccccgcccctggcaaccactgtctactttctgtctccatggatttgactacagtgtgtctaagtgggatcattcagcatttgtccttttgtgactggcctatttcacccctctgttttatacctttctgctgcgtggcgctttggctttctatgttctgcggcggtgggtggtaaagtggatgtcctgcttttaattctgagggctcgcttctcagttttcaaaaacacactttaatctctgattctccaattatcaagcatttgccatgaaatgatacttgctgctccccagcactgcagactgtgtaagagacatctcagccagcatttggattaagtcaaaccccaggaatccgcacctcctccacctcatcacccaataaaaaaggtaacgctgaggtattagaacattcacattagttccatgagcatgccctcttatgggcctgagagcacccaggctctggtgcaagccccccacagcccagggaagtgtttcaggactggagccctgctcagtgctgtgggctgcacaaggggtcaactgaggacccctaagcccaggagtggcagaggctggggaccatcccatgggctcccaggatggccttggggccacagggattatggccaggcttgtacttccaaagcccttccagggaggaaggcgctccacttcctgctttggcttaaaaaagtccagggaagcacctgattggcctggctcaggtcacatgacactccctctgtccaatcactgtggccaagagaatgcgctattgtgattggcccagcctgggtcagagccttcccctgctgcctggagcagggtctgtctccaggagagaggagtagggttcagccattccaatggcgctgccgcctgaagagctgtcagtcctactttgcagttgagctggctctgagaagaaagtgctctgcctagccctgtgattgatccacaacttcatggggactcaaacatgggttcttttattccaggtggagaaattgaggccccaagcaggggcagactcactggggtcacatggtgagttggtggcatgaatgggtgctccggtctacactgtaccacctcctccaggaagccttcctggcttggtcaagccaggcctggggtggtcaccacctgatgtcacatccccttgagacaaagccccccccctcccccgccaccaggcacctatccccagtgtccaggacatagctactggattcaggcagcttctgcagatgagctcccagccctatgtccaggaggtttctggaatcgacagctctccatgccacaataccctccatggctatttagggaacacccagtgtgtgccaggttcggctggcctgggagagtgcacagtggacactggtcaccaggagacacagggggccagtccacacccttccgcagtcgggcctggggaatgggttgggtactgacctggaggagggagggacagcaggaagggctggctgggcctcagctctcttgcttaccttccattctctcgatggccctggctagacacatgctggctcgcccaggccctactcatgtttcggcacaacgaccctgctctgcctccgtccccaagaccctgggctgtgcaaccagggccagacctgttcttcagccgcaccagggcctggctgtgcctctgcctgtcagtggccaagccctgagcctggagccatccagagccgcacggaacccacagcctgcagggtggggctagacatggctcctcctgcccgcccgtgggtcgtacaccagctcattagagccaaagcagcatcgattttgtgaatgatgagcatgtgtacgtgtttttggagccctggtgtgatttggcgtgtgcagctgatgattcaggggggtcatgtgcaaacgacacgccttataaatgtgaacccaccagaacgccccgttacggagatttacactgatccttaaacatcgtagattaatttttggaaaacatctataaaataagagatttatacctaaaacaataccctatgctgtgacaggaagggattagagtcaatttattcctgtattagtcaaaaactcaatttcatatattgtgtggaaaaattaaaaccctttctacattttattacaaattatgcatactccatatatggagataaataattgatagcattacaaatacttaatctagaaaatatttattaggaacagacaactcatttttcatgtgttttgttgagaacaatattgcacactttaaaaaattaatgatgactctttgcaaaaataaatgtctacatcctaattcttttgtttagcattgtgtccaagccaggcagacgcagccgggcagtgggcaggtggccatggagctgggatgtccactccctggcccctggctgtggatgggtcagagggctcatgtgctgtggcagttggccagggaaggtgcatttggagagtgtcaacatactgtttgtcttctgctgtgcaaactctcctcgacttgtaatttaa

SEQ ID NO: 25 - DNA, 246329 bp, Homo sapiens
  misc_feature (39114)..(39114): n is a, c, g, or t
  misc_feature (39134)..(39134): n is a, c, g, or t
  misc_feature (39136)..(39138): n is a, c, g, or t
  misc_feature (39140)..(39141): n is a, c, g, or t
  misc_feature (39143)..(39143): n is a, c, g, or t
  misc_feature (39238)..(39238): n is a, c, g, or t
  misc_feature (39242)..(39242): n is a, c, g, or t
  misc_feature (39248)..(39248): n is a, c, g, or t
  misc_feature (39258)..(39258): n is a, c, g, or t
  misc_feature (39285)..(39285): n is a, c, g, or t
  misc_feature (39289)..(39289): n is a, c, g, or t
  misc_feature (40493)..(40493): n is a, c, g, or t
  misc_feature (54900)..(54900): n is a, c, g, or t
  misc_feature (61609)..(61609): n is a, c, g, or t
  misc_feature (61615)..(61615): n is a, c, g, or t
  misc_feature (66371)..(66371): n is a, c, g, or t
  misc_feature (66375)..(66375): n is a, c, g, or t
  misc_feature (66423)..(66423): n is a, c, g, or t
tatcagtgaaagtgctgtggacatcactgtgaccgaacctgctgatttaatttctgtcacaagagctcccacataggtttcccaggggtagtctggaggctcagtgatgagctgccacctccatgagtggctctgtcaacccctcctccacccacctcttggtggtagaatggctgccacagccccacacttttcatctcctcccatggccctttggatggccatggatccctcctccctcagcagacctccctcacagaactgcatctggaccatcctccaaaatcagagtgctgctatgatgggggaggcagggtcattggtcaggagagccagcccaacatttgctgagccctcttcctcctagccctggccattccttcatcctttcccattctcaccctcaatacctattccagccttggagctccagacaccatctttgtgacagtgactcacaagtgcacctccagcctggcctctctctctgctccacgctcttgtttctggagcctgctccacatctccatctccactaccaataaagttctcccagtcaccatgccagaaaggaactcaaggtcttctcaaaatccctttcttaccctatgttctccacttttacaaatgggccactgcccacctgtccatctctagtgctcattctcttctacctatttgcctctgcgtgtgccctgcctctttaccagtccaccttggtaaatggcccactgtggcactttttcaaaaagtttattttctattttgcattattttttgagacagggtcttgctctgtcacccaggctggagtgcagtggtgtgatcatggctcactgcagccttggcatcctgagctcaagtgatcctcctgcctcagcctcccaagtagctgggactacaggtgcaccaccatgctcagctaatgtttctgttttgggggggttttgccacgttgcctaggctggtctcaaactgccgagctcaagcaatccgcctgccttagcctcccaaagtgttgggattacaggcatgagccaccgtgcctgcctggcctgcccccctcccttttttttttttttttttttttttgagacggagtctcgctctgtcgtccaggctggagtgcagtggcatgatctcagctcactgcaagctccacctcccgggttcacgccattctcctgcctcagcctcccgagtagctgggactacaggcgcctgccaccatgcccagctattttttttttttgtatttttattagagacggggtttcaccatgttagccaggatggtctcgatctcctgaccttgtgatctgcccgcctcggcctcccaaagtgctgggattacacgcccggccttttttgtttgtttttttacttttgagacagggtctcgctctttcacccaggctggagtgcagtgggtgaccatagctcactgcagcctctgaacacctgggcttaagaggttctcccacctcggcctcccaagtagttgggagcacaggcacacgccaccatgcctggctaatttaaaaaaaattatagatagggtctcactatgttgcccaggctggtctagaacttctgacctcaagcaatccacctgcctcagcctcccaaagctctgaggttacaggtgtgagccaccgtgcctggccactctggcgcctctgaaacatgctggcaggttctctgatgctgctccctttgggagtttaattgggtttcttcctgaaacatgggctggccttcacgacttgcttgtaatccatagaatgcagcagaactgacatcgtgtggtttctgaggccaagtcacacacagagtcacacagatcagatcagcaacccaactccttctctctctctcacacatcttgggatgcttgatctttacacccagccaccatgctgtgaggggcacaggcagcctcgggagaggataggcgtgttcctgccagcagcaccagctgaaggacccatccaccccctgcacgggtcacctacaagtgagtgaggaagccttccagatggctctggccccggccaccattggactgcaaccacaggagacaccaaaactgagaatcccctccctgagcccagtcaagccccatgactatgaaatataataaaatagatgatgctgggtgtttttactgcaccaagtttgatgtggtttgttatataactatagataagcagaacgggatctggtactggaagtggggtgggtgctgctgatacaaaacctaaatcatgtgacattggctttgggatggggcagtgtccaggagctgggaggaccttgcagaggctgacagtggggacttagaggaaagtgaagaaattgttactggaagatggaggaaagaagaccattgttatgcagtggcaggaagtttagcaacattgtcacctgtagccaaataggaaatagaagctagatagtattcccaagaataaaatgatctaaggacatacccagagagaaagttcaaggtgctacttggcttcttctagctaccaataataaaaagaaagaagatatgattcaaaaagcaagatttagggccgggcatggaggcttactcctgttatcccaatgctttgggaagctgaggtgggagaatcacttgaggccaggagttcaagaccagcctgggcaacatagcaagaccctcatctctataaagaaaagttttttctttaagatggagtcttgctctgttgcccaggctggagtgcagtggtgtaatctctgctcactgcaacctccgcctcctgggttcaagcaattttcgtgcctcagcctcccgagtagctgggattacaggtgtgtgccaccatgcccaactaatttttttgtatttttagtagagacggagtttctccctgttggccaggctggtcttgaactcgtgacctcaggtgatccgaccgcctcagcctcccaaagtgctgggattacaggcgtgagccaccttgactcatcaccctggagcttcaggtacttctcttgatgtcctcatctcctaacatccttcctcttcctccccctcccctcccccttcccctccccctcccctccccctcacctccccctcaccctccccctccccttcccctccccctcctcctccttcttcttctccttcttcttttcttttcttttcttttctttttttttttattttccaagacagagtctcactctgtcacccaggctggagtgcagcagtgtgatcttggctcactgcagcctgcctctgccttccaggttcaagcaattcttgtgcctcagccacctgagtagctggattccaggcatgcactgacatacccggctaattttttgtatttttaatagagatggggtttcaccatgttgcccagcctggtctcgaactcctgacctcaggtgatctgcccatctcagcctcccaaagtgctgggattacaggagtgagctactgcaccaggccctcatctcttaacttctaatcttgctctgtccaggtccctgaaccaaccagctcaactatttgctacagctggtgggtcttgcaggttctgcctttgcagagtggatggcacagtgctcacagaaactctgccgtttgggagtctttgccctcatgctccactgccgttcagggctgcctgagtgagctgtggggcagatgtcataagtgaggccacatgggatggcagtcacctgctttcacagcttacgtgtgtcctctggacttgctgagagctgatcctcgtaatgccacttctgttgtgtggatggttggtaccttgagacctggtggcttggccaagcacagtggctcacgcctgtaatcccagcactttgggaggccgaggcaggaggattgcttgagctcaggagttggagaccagcctgggcaacatagcaagaccttgtctctacaataaataaaaaaattagctgggcgtggtggcatgtgcttggggtcccagctactcagaaggctaaagcgagaggatcgcctgaaagatcgcctgaacgagttcgaggctgcagtgagccgagatcaaaccactgcacttcagcctgagtaacagaacaagaccctgtctcaaaaaataaaataaataaagcctggcatggtggctcatgcctgtaatcccagcactctgggaggacaaggtgggtggattacctgaggtcaggagtaccagaccagcctggccaacatggtgaaaccccgtctctactaaaaatacaaaaattagctgggcgtggtggcaggcatctataatccgagctactcgggaggctgaggctggagaatcgctttaacccaggaggctaagttgcagtgagccaagatcacaccagtgcactccagcctaggtaacagagcgagactgtgtctcaaaataaaataaaataataaaataaaataaataaaagacccagtgggtgtctctgacaatacccagctctaatgagccttctggtcactcagtagcccatcgtcagatgcccagttcctgccagggcccagaaacgtggaaggagctgttttgttttgttttgttttttgagatggagtctcgctctgtctcccaggctggagtgcagtggcgcaatctcagctcactgcaacctccgcgtcccaggttcaagtgattctcctgcctcagcttcccgagtagctgggactacagacacctgccaccacgcccggctattttgtgaatggtatgtggcatggccttgctccagaaccctaggagtgggcactgccacccttccactgcagcctgctgaaggcgccacatgaaacctttctctgccaagcgttggccatggctctgtcaggtcacagggtcaggctcagggctgctggtaccacagcctggacctgcagcaaatcccatactgccctaggctctactaaaagctggcatcctccatatcacccacaaatttcttgggcagtattcccaagttttttccgcctccaaatcgcaaagaagcctcaccctgttgtgttctttcatagtggtgagaggagctgggcgctcgcccttcgccttggaggagttgctctggcatcccaggccgctgggctcccagaggctgcttttttttttgtctcttcttcattaccggtttgtgagagttctttgtatatttaagatactagtcccttatcagatatatgatttgcaaatattttctctcattctgtgggcagtttttactttttccttttctttcttttttttttttccagagacagagtctcgctctgtcgcccaggctggagtgcagtggcgcgatctcggctcactgcaagctccgcctcccaggttcacgccatactcctgcctcagcctccccagttgctgggactacaggtgcccgccaccatgcccggctaacttttgtgtttttagtagggatgaggttttgccatgttggccaggctggtctgaccttaggtgatccgcccacctcggcctcccaaagtgctgggattataggagtgagccactgcacccagcctttacctttttttttttgaaacaaggtctcactctgtcgcccaggctggagtgcagtggcatgatcatagctcactgcagccttgacctccttggctcaagccatctttccatctcagcctcttgagtagctgggaatacagccaaatgccaccatgcctggctaattgtaaaaaatatatatatacgtatacacacacacacacacacacacatatatatatttgtagagacaaggtcttgctggcctggcacagtggctcatgcctgtaatcccagcactttgtgaagctgagatgggcggatcacctgaggtcaggagttcgagagcagccaagccaacatggtgaaaccccgtttctactaaaaatacaaaaattagctgggcgtggtggcgtaggcctgtgtcccagctactagggagtcaaaaaaaaaattgagacaaggtctggctatgttgcccaggctggtctcgaactcctggggtcaagcagtccttccacttcagccacccacagtgctgagattacaggtgtgagccattgcgcctgcccgttttttgcctttttatttttagagacaaggtctcactatattgcccagactggtctcaatctcctgggctcaagtgatcctccagccacaggctcccgaatagctggaagtccagacgctcaccagcatgcctggcttcagctggcattttaataggagttatattgaatctgtagattagttttcggagcaatgccatctcaacaatatttaactcttccaagccatgaacattagatgtcttccatttatttagtgctttgatctctttcaacaatgttttgtagttttcagagtttaagttttcattttgtttacatttgttccctaatattttgttcttttttttttttttttttttttttgacagagtctcactctgttaccaggctggagtgcagtggtgtgatcttggcccactgcaatctccgcctcctgggtttgattcccctgcctcagcctcccgaatagctggcactgtaggcgtgcaccaccacacccagctaatttttttttttttttttgtattttagtagagatggggtttcaccatgttggccaagatggtcttgatctcctgacctcgtgatccgccctccttggcctcccaaagtgctgggcttacaggcgtgagccaccgtgcccggccaatactgatgcattttatttctttttcctacctaattgtagagctttcttttcttttttctttttctttttcttttttttttgagacagagtctcactctgttgcccagctggagtgcagtggcatgatcttggcctactgcaacctctgcctcctaggttcaagtgattctcctgcctcagcctcctgggtagctgggattacaggcacgcaccaccacgcctggctaatttttgtatatttttagtagagacggggtttcgctatgttggccaagcttgtcttgaactcgtgatctcaggtgatccacctgcctcgttctcccaaaatgctaggatcataggcgtgagccactgtgcccagcttagagctttcaatacaatgttgaattgaagtggcgagagtgtacatccttgtgttgttcctgatcttagaggaaaatgattcggtcttcaccattgagtgtgatggtagctgaggatttttcataggtgccctttatcaagttgtggaagtgtccttctttttttttttgagacaaagtctcactctgtcgcccaggctggagtgtagtgacgcaatctcctctcactgcaaccttgcaatctccgcctcccgggttcaagcagttctcctgcctcagcatcccgagtagctgggattgcaggtgcgtgccatcaagcccggctaatttttgtattttcagtagagatgggttttcaccatgttagtcaggctggtcttgaactcctgacctcatgatcttcccgcctcggcttcccaaagtgctaggattataggcgtgagccaccgcgcccagcgtgtccttctagttttgggattaaacaacatgatccactggtttttgcaggagccagataatgtattaaactgggatttgctaaagaccacattgcaacctcctttcaatctttatttatttattttttgagacagggtcttgatctgtcactcaggctggagtgcagtggtgtgatcaacactcactgcaacctcaccatcctgggccctggtgattctcttgcctcagcctcctgggtagctggcactgcaggcatgcaccatcgtgccgggctaaattttgtgtttttttatagagacagggtctcactatgttgcctaggctggtctcaaactactaggctcaagcgagccccctgcctcagcctcccaaagtgctgggattacaaggcatgaccagccactcccggccatcctttcaattttcaactgagacctctaagctctgctatccttcctgggacgcagcactgtatttttttcttttgagacggagtcttgctctgtcgcccaggctggagtgcagtggcgcaatctcggctcactgcaagctccgcctcctgggttcacgccattctcctgcctcagcctcctgagtagctgggactacaggcgcccgccaccacacccagctgatttttttgtatttttaatagagacgaggtttcaccatgttagccaggatggtctcgatctcctgacctcgtgatctgcccgcctcagcctcccaaagtgctaggattacaggcatgagccaccgcgcccggccagcactgttttttttatcttggtaggggcagttcaggaactttcatgtagcctttattgcaaaacaggtctcacttttgagaactgaaagtaaaatcctaagcactcccaccaactgaaaagatcccccttgaccaaaggaccccagagaaaccttaaaaactgagttaacagccatgacaggacagaaggtcagacatgcctcgctgtaccctgtcccttttgtggtttaggcacaactgaccaacattaatgttaaaatagagatcataagactgacagaagagactctggcaaaacgataccaaattataaacaggaccaaaggccatgctaggcaaggattaagtcatgcacccctatacttaaagaagaaactatattctgtcacaggtggtttttttttcctctaacagttaaacaagcactagcctcaagataaacaatattaaaacaattacaactcaaccactgccagacactcactgaccctcctgttgtacaagccacaactacagctttgataggacatgagactggatttagtaactttcttctgataaaaagaccatccaccctagactggttctggctggttacagaggctgcacacttgcgtgccttcacgtccgtccctacttcaccttctgacgtgtagggcctaattgtaatgcatttaaatgtgaagtctccgccccaaagtaaacatggctgcatgggacatgcgtatttgcttctcacatatgcacatgttcccccttcatgaatattcacagctcctcctagatcctgttaaatatgtatacttggctggcctggtgcggtggctcacgcctgtaatcccagcactttgggaggctgaggcaggtggatcatgaggtcaggagatcaagaccatcctggctaacacggtgaaaccctatctctactaaaaatacaaaaaaattagctgggcgtggtggcgggcacctgtagtcccagctactcaggagaccgaggcaggagaatggtgtgaatctgggaggtggagcttgcattgagccaagatcgtgccactggactgcagcctgggagacaaagtgagactccatctcaaaaaatatatatatacacacacacacacacacacacacacatatatatacatatatatatacgtacacatatatatacacatatatatacgtacacatatatatacacacatatatatatacacatatatacacacatatatacacatatatatacacatatatatacacatatatatacacatatatacacatatatatacacatatatacacatatatatacacatatatatatatgtatacttggctctcctattcagcataaattcctgtttcaccgctctcatcctaaacatgcctgtcttttgatctctgcgagaggctacacttcccagcctggccgccttgcaggctataaccctttataagaaataaagttggcagagcacagggctcatgcctgtaaccccatagtcccagcactttggaaggctgaggtgggaggatcacttgaggccaggagttggagaccagtctgggcaacatagtgagaccccatctctacaaaaaataaaaaaattagcaggtatggtagcgtgcacctgtggcctcagctacttgggaagctgagaggggaggatctcttgagccccagaatttgagactgcagtgagctatgattgtgccactgctctgcagcctgggtgacagagtgagactgtctctagagaaaagaaaataaataaagtctcctttctaaatttataaattgtgtgatttttcagttggcactctacaggttagaaatcactgtgaaagttctgccaaatactaaatatgtctattccaattatgcattcagaaactgcagaaataacctgtgagtagctcatgaattgctgggcccactgtgggatggaattgggccaggactttgcgtactgcccggctgtctgtgctcctgctctagcagggaggccatgagggcactttgggtcccaggaatcagtgctgacttggagccagtatccaacagcactaaaaagatctgggttttccctttccccagcgcacagctacctgagtaagcggaaacaggccccttcgtgaaaggatgaggggaatcactactagaagtacctttcatggtgttcctggctccttcctcatgggaaggagacttcagcagaggaggtctgggcctgagaactggctggacactgggcgacactgagacatttcagtgggcaggtgacctgacctcagccttttgcccttctattatttttacttatgtttttaaatgtaaaataaagacagcatagcatttaccattttaacctttttgtttgtttgtttgtttttggtagaggggatcttgctctgtcacccaggctggagtacagtggtgcagtcatggctcactgcagcctcgatctcctgggctcaagcgattctcccacctcagcctctggttgctggaaccataggcatccaccatgtgtacctaatttttgtatatttgtagagactgggtctcacttatttgcccagattcattttaaccttttctacgtgtgcaatacaagtgtgcattaaggatatccacaaggctgtgtaaccctctccgcgaccattcccagagctttcctaatcagaaaactgtaaccattgcacagtaattgcccttccctgaactcccagcccccggcgagcggggctcatggctgaataacactgcactgcatgtgcagactacattttgtttatccacttatccctccagggtccttgggttgtttccaccctctggctgctgtgaatagcgctgctgtgaacatgggtgtaatgcgcttgcttcagttcctgcattcagcccttctgggtatatactgaggagaggaattgctggggcgcatggtaattctatgtttagggttttgaggatccactgaacttttccacagctgcatcttacattcccaccaggttcccataaaagttctactttatccacgtcctcaacaacatttgttattttctggttttaaaatgtatagacatcctagtggggatgaagtatttttctcattctgacttttttttttttttttttttttgagatggagtcttgctctgtcacccaggctggagtgaaagtggtgcgatcttggctcatcgcaacctccatctcctggttcaagtgattctcgtgcctcagcctcctgagtagctgggattacaggcgcccgccactacactcagcaaatttttgtatttttaatagagatgggtttcgctaggttggccaggctggtctcgaactcctggcctcaagtgattggccagccttggcctcccaaagtactgggatcacaggtgtgagctattgtgcccagcctctttgcttatttatttatttatttatttatttttatttatttttttgagactgagtttcgctcttggcccccaggctagagtgcagtggcacaatctcagctcactgcaacctccgcctcctgggttcaagcaattctcctgcctcagcctcccgagtagctgggattacaggtggctgccaccacacccagctaattttgtatttttagtggagacagggtttcactacgttggccaggctgatcgtgaactcctgacctcaggtgatctgcccaccttggcctcccaaagtgctgggattacagatatgagccaccgtgctcgtcctctttgctcatttttaatgtttttttcttttttcttcttcttcttttttttttttgagagagtctcgctctgtggcctaggctggagtgcagtggctattcacggctcactgcagccttgaaatcctaggctcaggtgattgcgtgagccaccatgcccagccagttgtttgttgttgttgttgtgttgacttacattattttttccaatatttcatcatgaaaattttgatgaaattttcatcaaaatattcagataatttgaagggatattcactgtctagattattcaattattagtattttgctatagttgatttatcactatgtatgcattcgtcttttatttttacaaatggggtcttggtatgttgcccaggcttgtcttgaactcctggactcaagtgatcttcccgcctcagcctcccaaattgctgagattataggcgggagccacagcagcaggccaggattgttttttattaattttccagtggcctgccaatggtatatataaatccagtccatgtttgtgtagtcatctggtaactgttttagcatcccagcacacagtcaagaaaaataaactttaaaaataactaaaataactaaataactaaatggcccaggcacggtggcttacgcttgtaatcccagaactttgggaggccaaggcgggtggattgcctgaggtcaggagttggagaccatcctggccaacatagtgaaaccctgtctctactaaaaatacaaaaaattaaccaggcatggtggcgggtgcctgtaatcccagctacttgggaggctgaggcaggagagtcacttgaacccgggaggaggaggttgcaatgagccgagattgcgccattgcactccagcttgggtaacaagagtgaaactctgtctcaaataaataaataaaataactaaatggaaattctagaactgaaaaatgcaacatgagaaataaaaaattccctaaataggcttaacagcagaagaaagataacagtataacagaagagtcagtttgagactagccggataatagaaattatccaatctggggtgggatggtggctcgcacttgtaatctcagcactttgggaagccaaggcaagcaggtcacttgagctcaggagttagagaccagcctgggcaacatggcaaaaccccacttgaatttctacgaaaaatacaaaagttagccgggcatggtggcacatgcctgtagtgccagatactcggaggtggaggcgggaggattgcttgagcccaggaggttgaggatacagtgagccaagatcacaccactgcactccaacctgggtgacagagcgagactccatcttaaaaaaaaaaaaaatcctggcactttgggaggctgaggagggcagatcgcttgagcccaggagttcaagaccagcctgggcaacatagagagacccccatctctataaaaaatacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaacaaaagcaagtaaaagaagattttttttgtatagagtcaataatatataaaagggcaaaaataggccgggtgcggtggctcacgctgtaatcccagcactttgggaggccaaggtgggcaaatcacgaggtcaggagatcgagaccatcctggctaacacggtgaaaccccgtctctactaaaaaatacaaaaaattagctgggcctggtggcggccacctgtagtcccagctacttgggaggctgaggcaggagaatggcgtgaacctgggaggcggagctggcagtaagccgagatcacgccactgcactccagcctgggcgacagagcaagactccatctcagaaaaaaaaaaaaaaaaaaaaaaggcaaaaatagagaaaataatgaagccaaagataaacaaaattaataaactaaactgaatcagaaaaaaggaacactaattactaatatcaggactgagggaagggatgtaactatagattctgcagaatttaaaagaataataagggaatataatgaacaactttattaataatctatagttaacctgcagttaatatcatactttctggcaaaacgttggttattttctccctaaaattaagagtaaagtaaggatatccatgacacttctattcaacgttgtcctggaggttttagtcagtgcaataaagcaagaaaaatatagaaaaggtataaagggcttggcatggtggctcatgcctataatcccagcattttgggaggccgaggctggaggatcacttgaggccaggagtttgaaaacagcctaggcaacatagtgagaccttgtctctaaaaaatattttttaaaaattagcagggcatggtggtgcacacctgtagtcccaactacttgggaggctgaggtgggacgatcacttgagcctgggagttggaggctgcagtaagctatgatcatgccactgcactcctgcctgggcaccagagcaagactccatgtcaaataaacccctcaaggccgggcgcggtggctcacgcctgtaatcccagcactttgggagaccaaggcgggtggatcacgaggtcagcagttcgagaccagcctgaccagcatggtgaaaccccatctctactaaaaatacaaaaaaaattagctgggcatggcggtgggcacctgtaatcccagctacttgggaggctgaggcagaattgcttgaaaccagaaggcagaggttgcagtgagcctagattgcaacactgcagtgtagcctgggcaatgagagcaaaactctgtctcaaaaaaaaaaaaaaactctcaaaataaaaaacctaagtgcgcaaggccatccactcagatacaccgccccacacatcagcgtcccaccccttcactatcaggctgtcactttgctgtgagagccttgtttaggttgagatcccctgcttctcctggagttcggctgtgctccactaacccccggggcctcatcttcatttctgtccacccgccggccagtctctgcatgtgccagctgggctctgatgcggggcactctgcttcatgctgttgatcggtgtgtctggatctgtcatgttctctcctcaaggaatcaacagtgcttagcaacagcctctcagtcccatggctcttggagttcctccccacctctcaggtgcccagggcactgcaccagtgacactgcctccaaatgtctcccatcccagttccccctggtgacagttcttactgtcacactgtgacccaggccgggggctgtcagttctccacctgacaccttggcatctacgaggatggaacaccacaaaatgctggaaacacgagaagagtgacagctcctcgttgccaccctgccggcgcaggagccaatttcagagtgctgtccttcaggtgggcttcccagggccacccaccagacacccactgttgaggtcgagttccctagaagcaaagcctgaagcaaggattcttgttctcgggctgttgctgagcgtgtgcccaggagagtgaggaagtctgtgctgccttccggtggtgctgagccctgaacggtttccaacaggagcttacttgttcatacttccagaggtcaggaacccagatcagggtgtcagcagtgtcgtgctctcggaaggctccaggggacagtctacccggtgcccttctcccagcatctggccttgctggacccactgggcattccttggctcacaaatgccccctcccatctccaccttggtcaccacatggtcttctcctgtatgtggctcttctcttctgaggacttcatcagtcttactgggttaaggacataccctactccggtatgacttcatcttcatttgcatggttcttgttgttgtctggtttacaggcagggtcttgctctcttggccaggctgaagtgcagtgatgtggtcacagctcagtgcagcctcaaccttctgggctcaagcaatcttctcacctcagcctccaaagtagctggtaccacagatgtgtaccaacatgcccagctagttaatttaagtgtaattacatctgcaaagatcttatttctaaataagttcacattcacagataggatgagcgaggactttggcatctctttgggagacacaacagaaacctagagggactccccatcctgatttgcctgtgactttcccaggttttggtgctgacagccctgctttccgggaaattccttagtcttgggaaaactgagatgcctggtcaccgtggaagtaggacagggctgggtggtagagtgcagactgctgagcagaaagctgtctctgttacaggtcagttttcatcattccacatggaaccgctgtggcagacactgagaacttcacagatctgaaccacctttcggcaaagcagggatgcccaggtatcagccattgtcagggttctgcctctgggtctggagggctgctgtgtgggtggctctcattccccaggacaattctccaagaccaaggtggccatgagccaccaggaggcaacagtcagcagctggggaccagtaggctgacccctaaaggggatctgaatagagccatctatgcacacccatccccttgtcttcccagtaaatggcccgcggccccacctactcacctgggtaaacacacacctcgactcctgtgcaccttggtaaacacacacctgtccgtccaggtaaatgccccactcactcacctgtgcaccttggtaaacacacacctgtccgtccaggtagatgccccactcactcacctgtgcagcgctcacctgactctagagctgctcaaggctcagctggtgggcaatgcttagcactccctactcccacctcggatctcatcgtccacctccagctccatctggtattgcccacgcctgtccctctgcactgcctccaccttggcgccagtcgtagatgtctgccaccggcacccccacagtggctggcttttgaacccactcccagcaacttttctctcctgtcctcctccccaaagtgagcctccccgagaggcgtcaatgcttgccacaaacagaagtcccatcatggcaccctcacttcagatgcccggagtgagtggtcctcagtccctggaagccctggactctgccacctctcccatctgtcccctccctcctcactctcagctgcccaggtccctggtcagctccttcaatgcatccaccctggctccttgacgccctatcctggggctcctggcacctctgcaagggggccttccctactgtccccacctgcacctctctagacaatcccagtgctcccggctgccaccatttctttccccgactaaagaacagacctgactgtttccaggactggatgaaactgaggcagatgaagagggcagggatctggaggggctgggggagaattagaggccacagaggaatggagctttgggtgggcacggacagaccactggatttggacagtcagggccgggacgcaggagcagctagggcccagggagccgggggttaggtccctcagatcccgcacatgcaaaagtgaggctgaggtaggggggtggtccctcggcatgtgagcccagggggttcccgagccaagtggcagccggaacagtggggagggacagccaaggaggtggggaggggtcgctggccccgctcagggctggttggggtggaggaagcccgggcccaggccgccccccgctgggtcgaggccaccccgcctcgagggcgcggccgtccggatctcctgattgctttctttcatctctgttcctttctcagccacaaacgcccgctaatgcctcttttatcacggaattaggggatttagggccggtcgcacaaaggggccctcgatagcggccataatcaaaccccaatcggccgaccttggacgggccggggaagaaaggagcgccggggattagcgcggtaccgcggccgggcaggcagagatagcatcggcgccgctgcggggctgaagccgcggagggctcggccgcgctcggagaaaggacggcttagctcctggagccggggattctgaagccattaggtggggattaacacccaagttaatctgctttggtcgctcaattgtcagcagcgaacgcgcgggactgaggaagcctggctcccagcgaccacagggccttgccacccagcagtccagagctacgagctggtatcagtttccccagctgtcacccggccaaggcgggccttggagccaaaagggagatgcacaccttggtgggctggccaacgggtctggatgagtggaccccctgccccgccagccttcctgggtaatcagggaactcagagaaggatgttcctgccccatcctgacccagaccacttgtggaccctgacagccagtgcagccctgggtgccacccacacactgagcttgggttgcacggcaacatgcatgacacacctgtccccatcaagcagggtcagggggcagcctgcagactgggtggacgctgacagcagctagcagcccccttgcagaccctccatcttccctttggggtccctgtccaggtatagccccctaaagacctctgttgaccaactcactgacagggcagatgtgacaccacctgctctcaattcatcctcactcttcatcttcagtcctctctcactaggcggcagagggagggactggacctatacaggtcccaggtaggtcctttgtctctgtctgggttttcctatctgaggaatggagccggctaaggaaaggcccaaccagaatgtgccagtgtcgtgtgtggcctgtgctcactgctatcttctgtggggacgcaaccccaaccctgactccttctcctgttcctgccagcaggcccccagagtaggtggctcagaggggtgtgcttacacctgcctcctcctccatggagatgtggcaaggtcactgtgccttacatgagcctacaggcagcaacaagtggctggactggagctgaccaggcaggcaggatggggtgggcagtagcagaggagaggccagtggagcgctctgggtccccatcttctttcccatggctgagactagggacattggaacaaaaagtcccaagtggaggaaaagacgcagtcataagtacatttgtctttccttccctctcatctcccttcctccctttcttccttcagcagtgaccaacgattctcccatccaggccctgtggaggggacacaggcgtgagccacagacccaggctctgccctctgggagcttgggtccgaggacacagttagacaaccggatgggagggcgcccttcgggaaggggaaacaggcaccccacatgcacagggccaggcagggcctgaagggcagtgtgaattacagggaaaatgcggagggagaggaagagtgctccagggcgaggaagccgcgcccgcagcgatctggagtgcggtggggagcaggtgaggcgggagaagcccagttctgggacacgcaggccagctctaggcaggggaaaggaggggcgggaggccagggaatgttccctcaggctggtgcgtcagaatggcccaggcagcctccagcgtgggcccccgctggtcccgggaggcgccgccagaggctcggggagggtggacgatgtggctgggccggcgagaatccaggggctgcaggcaaggacggggactcgcgatgaaacccgaagatcaggggctggtggcagtgaccgcgaggggcctccaagcagcccaatcaatctcggacgaggggtcgagtcagtggcggtgcaggcggcaaaggcagccagggtctgagcagcgcggctccagccccagcagcaacgggagagcgcgtgcgccgccccagacgactggacgcgccctcgtgacgccatcagcgcgcgccgccccaacttccgagcgcaagcgtggtcgcccccacagcctgtgggctacgggaacgcgatccgactcggcggccctccctgcctggatggccggtccccgaggctgaggaagtccattcctctttcggaaatggtccccaggaagcttctccgtgtccccctatggccgggtactgagcggggcccgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctgggcttctcagggagccaacactgtggccacagctgctctgccctgggtggacactaggctttccctgtccccctactgcagtgtcctcagatgggggtggcctggtcccctgcagaggcacagccaccaatgcccatgcatagatgggtccatacagggacgaacacaggacaggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccaggccccgcccccagcccgccccgtgcgggccgggaaactgaggcctgggcggggcgcgccgaggcaggcgtaggggcggggccaaagcgcagccaatggccgaggccgagtccctgggcgaccgcgagcggcgggacgggggcggggctgcgggaggcggagccgtggcccagctccgagcagtgggtcaaggtgcactgtgtgccgcgccgcgggatagcgggcctcgggtctgcgcgactgtcgagagcggcgggatccccagggatcccggaggccaggggcacaccctccccgaaaacacgtggggctagcccagtcccagaggaactctaacgtttcaaacctggaggcgggaggcgggaggccggtgagaaggggctacgccgccgggcccccctcccgcagcagccacgggccgggcctcacctgccggttcccacccacacctttcccggttgtagtttctgcgctcagcgaacaaggtcaggaaagaccacaaatgcaagcggctgtattctcctaggcagcttgtctgggcaacggaggtcccacaccccaaagaggacccagcaaatctttaatggactgcggggcctaggaaactggcccgtccctcctacccataccagcaccaagcagagcacctttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggtggcgacggcgcaggcgcagtgccccgagctcccggtcctggcccccgccctcctccctgaccgcgccccggcccgcaccccctttccccgccccttcccccgcccctgccccgcccctgccccgcctctgccccgcccctgcccccgcccctgcccccgcccctgcccccgcctctgccccgtcccgcctgcgcggatccctccgcccgctccgagggtccgcggaaagtagtcccgcgcgccctctgccctgacgcggtgtgtgccagctacccgagtgaaaggttttcgggggattaatcctgatggggtctgcggcggcccttgcccagcgccttccacatgtggagcgggccagtggtgctagttctgccgccaactctggacggttgagttcagggccactttttactcaggcacggatgtgacagaaagatggaaaagggtcttggaagaaccacatgtgccgtataacgaacgaccttttggtctgaggaggaccgtgtatatgacggtggtcccataacatgataacggagctggaaacttcctgtcctctggtgagggcttagctaaggacatttcctctcctgtatttggagatacacgtacaggtatgtcattaccgtgccaggggaataacgcacctcacacgcggtgcgggtttgcggcctagcagcagcggaccgcatcagctgcctagttgtgtagtggctgtgccatctgagtttgtgtaagttaccttgtgatgatcccacaaccgagacgcatgtctcagaatgcatggatgcatgggacgcgtgactgtacgtgttacagacgtgtttcggcgtgaggctcggcccctgctcctttaggaaacacctttcctggctcatgcggtttctagagaacactgtgtcggaatatcaatgtagagagtcagcgaaggtcatctagcagcagatgaccagccccaggccagtgaggatcacccagagtgcccgtggctgcacgacagtagtagcaggtggaagctggagcccacacctggtttgcccagcagccagttgtttttccgaggcaccgttggctgatgttttgcatacagatgattcagctgcataaaagatgtctgtcaggaaagggaagcccttggcattcagcacaggcactccctacggggtaatcgatagccgtctctgctgcttcccatgttgctcactggtaattttaagaaatgaacggcccaccttgaataagacaaggatggtgcaattatttgcgcaatggcttgaccatctagtagccaaaaatatgttaaggaatagaacagactgttcactttcaaattaaatctcttttccagtattagccaagacctctgcagcccgccctttctaaaatccatgtggcctcatccgctaaatatagagctgggttttgctgtggttagtactacatttcccaaatctctttattttggcaatgatgcctgtgactccaagtaccctttaccccaaacattatataaattttttagtaattaataccatcactccctaaatcaccttccccagggctttttggggattaaaactaaaattttataccctaaaagaaagaatttaagaaaatcatagttaagcaaagtgacaggattgttaatacgtcgggacctcaagtggggattaagtttcaacattaattttagaggagacacaaatctttctgtctcttcaaaccatagaagagacagaaagcacaacagttatttgaatagacagaagtgaatataagtgatagttgtagttaacaggaaataaagttgttaatatacttgtaaaaaaattaaatgttctgacttgaaagggactttaatattctcaccacttgtaggtaacttgctaagtaaccctaaaaaaacctttcaattcttttttttttttttttttttttgagacaagagtctcgctctgtcgcccaggctggtgtgcagtggcacgatctctgctcactgcaacctctgcctctcaggttccagccattctcctgcctcagcctcccaagtagctgggactacaggcgcacgccaccgcacctggctaatttttcatttttagtagagacagggtctcaccatgttgaccaggctggtctcaaactcctggcctcaggtgatccatccacctcggccttccaaagtgctgggattacaggtgtgagccaccgcgcctggcccgggattaagtttcaacattaattttgaaggggacacaaaccttcaaaccacagaagagagagaaagtgcatcagttatttaaacaaagggaactgaatataaacaatagttaacaggaagtaaatttaaaataataaaaagaaaatcccaagatatggagttacaaacataggacacagctaccacccctagagctcaaagatgaaagagaagctggaattattacagcttaaaggaagggcttgcagagctggaattcagatctctgaggaggtgtgttgaccagctggggctggggtcattgagcccagaggagagatcccatggggatgggactcagacctctgaggagggtccctacgggacttagacacacactatggatgaggggtggctgtggagctgggagtaagccctctaaagagggcactgggagactctcacccagatctctaaggagaaggcatactgaggctggttctgcaagtcttggaaaaacttaaactggattcagcttctgtgggaagaatgtgctgctgccttgttgaagaagcctagctggggtgatgctcacaggaagtggccctgtggtctccctctatcaacctatcagcttagtctaatagggaatattagatcagatcttctttatttgccaatgagaaatatgttttttagagtctcagccctggcatcagaagcagtgtctagaggtgggaagggagaatagagctgaaagacattatttaataactggtacaagaaacgacatgttatagctaaattccaattcccatgggactttcctataggtggaattgaaaagtctgtggaggcgtataatcgcagcgctttgggaggctgaggtaggaggattgcttgagcccaggagttcaagaccagcctggtcaaccccatctcttcaaaaaaatttaaaaattaacagggcatggtgatgcatgtctataggcctagttgggaggctgcaacaggaggatcacttgagcccatgagctcaaggttacagtaagctatgatcgtaccactatactccagcctgggcaacagagaaagaccctgtctttaaaaaagaaaaagtcactggaggactttagttttcagacagcttcagagaactaaaaaggcagtgaataattatgaggccaatatcagagagaaaggacatgagagaggtgagtggtttatggctgctttttcttgaaaggcatctgccaattccagatgaatgtttgagacactaggactctgagcagcacttttaacactctcattgccctaggacgacaaaatttggaggcttggtaccaccaaggaggtatcccactgtactgttttgggaccacaagttgtttgggactccattcaaatcatgtcagtccttgccagcagcaaatgtaaatcttccctgggaatgataacctcatccatggtctcaaattacttctacaattgttcatatgcagtgttcaacactgaatcaaaaataagtaggcatccaaggagaaaagacaaaatggttgcaaaaaacaagagcaagcctggacaacatagtgacaccctgtttctaaaaaactaataataataataattagctgagcatgcacctccagagtctgaggcaggaggatggcttgagcccaggaggtcaaggctgcagtgagccaagatcacactgctgcactctagcctcggtgatagaatgaggccctgtatctgaaacaaaaacaagaacagtaacagacaagtgagctctaggggatcaaaaaatggagttttcacaaagacttttaaataattatgcttaatatggttaagaggataaaagacaaggttaagaattttatcacaagcctgtaaattataaagaaccaaatggaaattctagaactgaaattgtgaaaattcaccagatagtgttagcatattacacacctctgaaaagagaaagctagtgatggtagagttaagtcagaagagtatatctaaattaaagcacagagataaaaggacagaaaataaagcatatgaataaattagatatagaggatacatgtagaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggcagatcacttgaggtcaggagttcgagaccagcctggccaacatggcgaaaccccatctgtgctaaaaccccgtctctactaaaaatacaaaaattacctgggcatggtggcgcatgcctgtagccccagctactcaggaggctgaggcaggagaattgcttgaacccgggaggcggaggttgcagtgagctgagatggcactacttcactccagcctgggcaacacagagtgagactctgtctcaaaaaagaaaagggaagggaaaggaagggagaaaggaagggagggagggaagaagggaaaggaaaggaagaagagaagaagggaatggaagggaaaataaagaaaataatgacattggcagacaaacaagatctgagaaaatttgttaccaaaagatctaaactaaaggaaatactaatgggtttttatcaggtcaaaataaaatgttctcaagtggaagctcagagatatagaatggataaaattcaacaaaaagtatatattggtaaatctaaatgaaagttaactgcatgacacaaaaataataaagccttctgggattaaaaatatgtcagaatttaggccgggcgcggtggctcaggcctgtaatcccagcactttgggaggccgaggccggtggatcacgaggtcaggagatcgagaccatcctggctaacatggtgaaaccccgtctctactaaaaatacaaaaaattagccgggcgtggtggcaggcgcctgtagtcccagctactcgggaggctgaggcaggagaatggcgtgaaccccagaggcagagcttgcagtgagccaagatcgtgccactgcactttagtctgggcaacagagtgaaactctgtctcaaaaaaaaaaaaaaagtcagaatttaaatatataaaatctatagtaagtcagaactggggtaatccaggcatcatctgagaaaggggtataaaaaaggttagatttgtagttgattgaataattggtcccaagtcttaaggccttgtaagagttctattcctctgcactcttgccatggctttgtagtggattgagggtgcttcttcaccccttggttccaggtttcaccctgtgccttgcttcagctcattggatgttagaagtgtgatatgagcagaaatttaactgtcccacattgtttggattgcactcttgcacttctgttgtgtccgtgagtacaatttgtcccccctagccattgccttttgagcttggagctcaggatggcatgtataaagtagatctcagcccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactacccttgtatgaaaaatgtaattctgttaaatttctttgtttgctgcctatataagtaagaccataacctttcagcttgggatcactgaccccattcctttggggtctgtatttccggatattcatcctcaactttgtgcttgcataaactcttaaactggattctgatgctttaaattatttcaggttgacatactagtgacccagatgggacctgaagttagcttctgccactgactcctgctgttttgctaacagataggtggtaccagtacagactgttgctggagtttatgggagccctaagtgagacccctcttgcattttgaatctccctggcttagatgagattcgtatattgttcaaatgacctgattccatactcaatggggctggaattaaagttctactttaaatctttaaggtaggagtttcatttcttatctctcgagagattctgttgtttgcaggtttacggtttcattcttttttaaggttaaggttttgtttgccttacttgctaaagtttgcaaccttttctctcatgcaaaatctggttaaaggaaaagcagtttccctttaataagatatgaatttctgtggcttaagcaaaattgtgaccttaaactagccaggttttgaagctcagttcaatttggcacatttaaattctttttttgagtgaccaaaaatttataaaagacctttattggctgggcacagtggctcactcctgtaatcttagcactttgggaggccgacgctggaggatcacttgagaccaggagttcgagaccagcatgggcaacatagtgagaccctgtctctgcaaaaaaataaaataaataaaaataaaaaaaaaataattaattaaaaaaaaatctttatgagaatgtgataagtcctgaaggcaacgtacactgttcatcctgaccaaaaggcaccttaggtgactgaggtcttgtaggagtgccagagattatcacttgtgatgagaaatggtcacacaggggatccccaaagaagaacatacagggaaatttgcttaaattcagtaaatatatataaggtactgatgtcccagtgccttaagctcccagaatttctgggtttcactgagacacataagaggaaagaactgatccaagggtaacacacgggggagctattcccataaataatacatttgatccaaaacatctttccctttcacttaagaggagaatacaaattataggcgatcagctatctaaaatagagtcctccttgtggagaggtccatctttagagactccagctggatacctgtacagtacttacggttttacttcttgtcattatttagaaaaattgtctcttgaagaactcacgaagaaccaaaattgcaatggccaaagtagggtactttgaaatgcctaaactaaattatttgtgtgctcaattagaaaaatccggttctggccgggcaccgtggctcacgcctgtaatcccagcactttgggaggccgaggcgggcggatcacctgaggtcaggagttcgggaccagcataaccaacatgcagaaaccccatctctactaaaaataaaaaaaaattagccgggtgcggtggcacatgcctttattcccagctactcaggaggctgaggcaggagaatcgcttgaacccaggaggcggagcttgcggtgagctgagattaggcgtcattgcactccagcctgggcaacaacagcgaaactccgtctcaaaaaaaagaaaataaaaaagaaaaagaaaaatcgggttctaggataaaatagaataattgggagatttatttttagaggtatttagaagcatccagaagaggttctgataaagttacttcactgcaggaggaaaataaaagattgcctaaaggctgggcacggtggctcacgcctgtaatcccagcactttgggaggccgaggcaggcggatcacaaggtcaggagatcaagaccatcctggctaacacggtgaaacccccatctctactaaaaaaatacaaaaaaaaaaaaaaaaaaattagctggacgtggtggcaggcgcctgtagtcccagctactcgggaggctgaggcaggagaatggcgtgaacatcggaggaggagcttgcagtgagccgagatcgcaccactgcactccagcctgggcgacagagcaagactccatctcaaaaaaaaaaaccaaacaaacaaaaggtagtcaactggcataaaatataaccatatatacaaaatccagagtcagttatgttatactttgaaagatgtaaaaagacttttagacaatattcaggcttatgtgaggtgagtgatgctaatcataaaaatgatactttcctgggctgggtgccgtggctcacacctgtaatgccagcactttgggaggccgaggtgggtggatcacctgaggtcaggagttcgagaccagcctgaccaatatggtaaaacctcgtctctactaaaaatacaaaaattagccaggcgtggtggcatgcacctgtaatcccagctacttgggaggctgaggcagaagaatcacttgaacccaggaggtggaggttgcagtgagccaagttgcgccattgcctccaccctaggcgacagagggagactctatctcaaaaaaagaaaaagaaaagatactttcctcaactccaactttatgaatgttctagataaagaattcactctaatagtaaagagacagtgccttagttgggccacttctcaaacccatgatttgattaatcttgctgacgggtcgttgtgtactttaaagaagaaaaagataaagaggccataccaaagaataaagtgagtaaagttatgaatttgcaactaaaacaagtatccaccaagtgtagacagtcaaaataccccaataaacctttgaacaggtctaatccttcaatctgtaataactacaataaaactggccactttccaaaaaagattactgaaaactaaaacagaaggaatgacaacagatgaaggaggaaaatacggaatagaggtgctccaagaaatttaaagggagctttccttttctgcttactaatattctgggaaaaatagaatttatttatttatttatttatttgagaggagtcttcgctctgtctcccagggagtgcagtggtgtaatctcgggctactgcaacctccacttcctgggttcaagcaattctactgactcagcctcctgagtagctgggattacaagcatgtgccaccatgtccagctaatttttgtatttttcgtagaggtgggttttcaccatgttggtcaggctgatctcaaactcatggcctcatgatcggtttgccttagcctctcaaagtgctgtgattacaggtgtgagccaccatgcccggcctcaatagaaattattttaagtaaagaacaataccaagtccttgttgatactgagcaacattatctgtaataaatctaaccttatcacaaagtcggggtaaacatttctgagggtaaacactcggtctaaatggtaggtgtcacaaatacttccatatcagcacacaagtctcaccctgcaacttctcaactaggtatcttacaagggaatcatgttttccttttggttccatcagcccccatccatctgataggaagagacttcttaaaactatataatgcctatatttctttctcccagaagtgggaaatatatttagaattagatggtatggatgacacaacagaattaacagacacaagcaaaaaatttttaaaaatttaatccagttactatccatctcaccattgaggacactgaattattaagcaatgaagaattagaaaacctactaaaggtagtacttgattgattgtggtcaaagtccttcactgatacagaaactattgtttcagctacttcaataacatctcataatattcatcaaaaccccttccaaatatcagatactatcccacgataaccttaggaggggtaaaacctatgatttcagattatataaaaagaggactgatcaggctgggcacggtggctcacacctgtaatcccagcactttgggaggctgaggcaggcagttagtctgaggtcaggagtttgagaccagcctggccaatgtggcaaaaccccatctctactaaaaatacaaaaaaaaaaaaaattagccaggtgtggtggcatacacctgtagtcccagctacttgggaggctaaggcaggagaatcacttgaacccgggatgcagagattgcagtgagccaagattgcgccactgcactccagcctagtgacagagtgagactccacctaaaaaaaaaagaaaaaagaaagaaaaagaaagaaagaaaaaaaaggactgatcattctctatacaagccctcataatacaccaattccccgttaagaaaaccaaatggtagaggatggagacttgtacagaatttgatagcaataaacgacataattccacagcatccggtagtgcctaatcctcacacattgctcatatctattccattgaatgcagaatttattattttgtgtgtgcgtgtatcggagtctcgctttgttgccaggctggagtgcagtggtgtgatctcggctcactgcaacctctgcttcttgggttcaagtgattctcctgcctcagcctcctgagtagctgggactacagacatgcgccatcatgcccagctaatttttgtatttttagtagggatggtttcagcatgttggccaggatggtcttgatctcttgacctcgtgatctgcctgccttggcctcctaaattgctgggattacaggtgtgagccaccatgaatgcagaactttttacagtcatagatttatgcagtgcattctttagcattcctatagataaaactggccaatttctctttgcctttacttgggaagacagacaatatacttggacattcatgctccaggatacactgaaagcctcacttacttttcacaaacattaataaaagacctctcagatgataacttcattgagaagcctgtctatttttttttttgagacagtcttgctctgttgcccaggctggattgcagtgtcacaatcatagctcactgtagccttgaactcccaggctcaagtgatcctcccacctcagcctccagagtacctgggactacacaatacaagccaccatgcctggctaatttctggttgtcctttttttttttttttttttttttttgtagagacagggtttgccttgttgcccagactggtctcaagaaaactcctgggttcaagtaatctgcctgccttggcctcccaaaattctgggattataggcataggattataagcataccacagctttttttttttttttttttttttggagacagggtctcactctgtcgcctagactggagtgcagtggcgctattacgtatcactgtagcttcggcctcctgggctcaagtgatcctcccactcaggctcccaagtagctggggccagaggcatgcacccccatgcacggctactttttttaactttttgtagagatgcgctcttactatgttgcccaggctggtctcaaactcctgactgatcctgagtcatcctcccgccttggcctcccaaagtcaaagtgttggacttacaggcatgagccaccatgcctggctgagaagcctgtctgaatacaatacatagatgatttacgtctttgcttagataacaaataggcttccacagtagatggaatacacctgttacaattggccctaatggatcataaagtgtctaaagaaaaacttcaattttgtaaaaacaaaacaaaaaaaccaaaacaactacttaggccacctaatatccaaggaatgactttctattaatcccgatagattgaatgcaattgtagctgttctgacactgagaaccaagaaacagttaatgttttagggactagcagaattttgtagaaattatactctaaacttttctttaaaagctctgcccttacatgctctcttaagataagacatgccagactctctagattggacagaagaaattcaactaatattagaaatgatcaaaaataggttgggcgtggttgttcactcctgtaatcccagcactttgggaggccgaggtgggcagattgcttgaggtcaggagtttgagaccagtctggccaatgtgatgaaaccctgtctctactaaaaagtacaaaaattagtggggtgtggtggcacactcctgtagtcccaactacttaggaggctgaggcacaagaatcacttgaacctcaaagatggaggttgtagtgagccaagatcataccactgtactccagcctgggcaacacagtgagactctgtctcaaaaaaaaaaaaaaaaaaagaaaagaaaagaaaggagaaatgatcaaaaatgaccttgctaacactccagctttggggcatccaaattataacatttcattatttgtgtatgaaagtggtggaaacaacactttaggggtcctaacccaaaaaaagagttcaaaatagacctatagggtattagagccaacaattagacactgtagcaaaaggactcccaccttgtatgagagccataacagccaccatttgttcattagggcaactgaagaaattgtcatgggaacaccccttactatcttcatcccttattctgtggaggtattgctatactcacgccatacttaacattattcagttagtagactggcttcatatgagatgttgcttattttagcttctcatatcatcatctctagtgtaacgatgtaagccctgcattcttttgccttcatttttacatgaaatgccacacaactgcatagctctaagtgatcaacatttttcttctaggtcagacctccaagagactccctttatgaatactgatgctatttggttcacagatggatgttacttgaaggatgaatcttgaatctaccaagcaggttgcactataatgtctttaagtgaggaaatagaaagtgcctattttctgaaagccatctcagctcaataaaaggaattaatagcattgaataggcctgtcaattggcaaaaagaatatgtgctaatatttatacagacagtagacatacttttggagtagcccatgatttggaaatgttatagaagcaaagagtgttcgtaacctcttaaggccaatccataaaaaacaaacttcttatttcatgactactagaaaaaatccctggccattattaaaattttgggtcattccaaatcagatactccagaaagcagaggatatcagctagctgataagtagcaaatagagctgctctaaacacatctaaacaagagaaccaacctgtgttaacttttaaggaaggacctgaatttgacataaaattagctcaattcagagccctaaaatcagaacaaaaagattgggaaacaaaagggggggaatagattccccaaaagatgaggtatggtatgggccaaacaagttgcccgtactttctgctgaattttagttgttattattattttttttgagacagagtttcactcttcttgcccaggctggagtgcagtgatgtgatctcggctcactacgacctcttcctcctgggcttcagcaattctcattcctcagcctcccagtgaatggagttttgctcttgttgcccaggctggagtgcagtggcgcagtcttggctcactgcaacctccacctctcaggtcaagcaattctcctgcctcagccaccacacctggctaatttttctgtatttttagcagagacagggttttcatcatgttggccaggctgatctcgaactcctgacctcaggtgatccacccgccttggtctcccaaagtgctgggattacaagcatgagccactgcgccctgtcatttccacattttttaggtatttcttacaagcagcaccccactcctcacgttaatctcatctagaaatgcccttacatacacagccagaataacgtttaatcaaatatctgggcactgtgtgacccagtcaagcaagttgacacataaccatcataaatatcaaagtatttgtggaaatattttaaaaactgctacaacatgtatattggcctggtgtggtggctcacacctgtaattccagcactttgggaggccaaggcaggcggatcacctgaggtcagaagttcaagacgagcatagccaacagggtgaaaccctgtcttgactaaaaatacaagaagaagattagccagccatggtagtgcacgcctgtagtcccagctactcagaaggttgaggcacaagaatcgcttgaacctggaaggcggatgttgcagtgagctgagatcgcaccactgcactccatcctgggcaacagagtgagactctctctcaaaaaaacccaacactgctacaacatgtgtataggtttccttgtgatatatttatatttacaaaatacatacttacaaatatatacatctgtatttactaaaacgtgattttttaaagacagaatctcactcacattgcccaggccggagtgtagttgcatgatcatggctaactgcagcctcaacttcccaggttcaggtgatcatctcacctcggcctcccaagtagcagagacaataagcatgcaccactacacctgactaattttttaattttttgtagagacagggttttgccatgttgcccaggctggtttcgagctcctgggctcaagccatctacctgccacagcctcccaatgcgctgtgattacagccatgagccaccacactcagcctcaaaagtattttaataagagagactagaaaatatcttcatggaacagttaaccataagaaatgacccaacgagccagacatggttgttcatgcctgtttattgatttggtatcctgctactttgctggattcacttcttagttgtaaccactgtgtatgcatgtgtgtgtgtgtgtgtatgtgcgtgtgtgtaatccttgatttaagattgtgtcatctgtgaacacagatcatcttttttcctttccaatttgcatgccttatatttctttttcttgtctaactgctgtggctagagattccttcctatgtagaatagaagtggcaagagtaggcatccttgtcttcttcctgattttagtggaaaagcttgccattattgtgttgaggcaattttcttctattactagtttgttgagtgttttatcataaaagactgttgaattttatcaaatgctttttctgcatcattgagataatcatgtagtttttcccattcattctgttaatgtcatgttttgggtgaagtaatctgtttacgcctgttaggtttaattggggtttattgtgttaagtcctctgtttctttagttaccgtctcatctgattgctctatacctatcattgaaatttggcagttgaaggccgggcgtggtggctcacgcctgtaatcctagcactttgggaggtgaaagcgggtggatcacgaggccagaagatcgagaccatcctagctaacatggtgaaaccccatctctactaaaaatacaaaaaattagccaggcatggtggtgtgtgcctgtagtcccagctactggggaggctgaggcaggagaatggcatgaacccgagaggcggagcttgaagtgagctgagatcgtgccactgcactccagcctgggcagcagagtgagactctgtctcaaaaaaaaaaaaaaaaaaaaagaaagttggcgattgaagtctctaacaattattgcagaactatctttttcccttcatttctgtccatttttgcttcatatatattgagggtttgctattaggtgtgtaaatctatatgattcttatatcttattgatatattgaaccgtttgttaatatataatattcttatcttttgtaatctttttaatttaaagtttattatatctgatattagcatagccagtccagctgtcctgtatttaatatttgtataggatatctttttcaatccttttacttttaacctatttgcatctttaatggaaagtgaacatctcttataggcagcctgtatttaaatcatgtgtttctagccaggcatgttggctcacgcctgtaatcccagcactttgggaggcctaggcgggtggatcacttgaggccaagagtttgagaccagcgtggccaacatggcaaaagcacattggtactaaaaatataaacattagctgggcgtggtgacacgcaccttcagtctgagctactcaggaggctgaggcatgagaatcgcttgaatctggaaggcagagtttgcagtgagtggaaatcatgccactgccagccagcctgggcaacagagctagactctgtctcaaaaaataaataaataaataaataaaataaaaatcatgtgtttcgattcttctgctaatctctcatttaactgggaattttaattcttggtattttgctatttgttttctatatgccctacagttgttgtttttttttttttttgtacctcatttccttcattactatcttctttgtttagtttattttaaatagtgaaccattttgattcccttctcatttcctttttttgcttttttgagacagagtctcactctgtagtccagtctggagtgcaatggcacaatcttggcttattgcaacctccacctcccaggttcaagtgattctcatgcctcagccccctgagtagctgggattacaggcgtgtgccaccacacccggctaatttatatattttttagtagagacagggtttcgccatgttggccaggctggtctcaaactcctggcctcaagtgatctgcctgccttggcctcccaaagtgctgggattgcaggcgtgagccactgtgctggcttctttttccccacctttttttggagacggagtcttgtactgtcgcccaggctggagtgcagtgatgtgctcttggctcactgcaacttccacctccagggttcaagcgattctcctgcctcagcctcctgagtagctgggactacaggtgcccaccgccatgcctggctaattttttgtattttagtagagaccaggttttgctgtgttgtccaggctggtcttgaacgcctgagctcaggcaatccacctgcctcggcctaccaaagtgctgggattacaggcgtgagccacgacgcccaggcttttttttgttttttttttgagacagtttctgtcacccaggctggagtgcaatggcatgatcatggctcactgcagcctcagtcttcctcagtctccttgaggtgatcctcctacctcagcctcctgagtagctaggactatagacatgcaccactacacctgattaatttttgtacttcttgtagaaacagggtttcacgttgttgcccaggctgttctcagactcctgggctcaaggaatctgcctgtttcagtctcccaaagtgttgagattacaggcatgaacgactgtgtctggccttcatttccttttgtctacaatttatagattttttgagataaccatgggaatttattttaacatcctaaatttgaatacaattttaacttcaatactgtataaaactctgcttctgacagggcgtggtggctcacgcctgtaatcccagcactttgggaggccgaggcgggtggatcctgaggtcaagagattgagaccatcctggccaacatggtgaaaccctgtctctactaaaacatacaaaaatttgctgggcatggtgacacacgcctgtagtcccagctactcgggagactgaggcaggagaacagcttgaacccgggagacggaggttgcagtgagcggagattgtgccactgcactccagcctgggagacagggcaagactccgtctcaaaaagcaaaaaacaaaaaacaaaacaaaacaaaaaaactctgcttctatacagctcattcctcctactttcttttattgatgttacaaattacatctttatatattgtgtgctcagtaacattgactaataattgtatttatgcatttgtctcagaaatcatgtagaaaataaaaagtggagttattaaccataattataataattacccatgtatttacctttaccacagatatttatttctttttactttttatttatttatttatttatttatttttgagacaggttctcgctctgtcacccaggccagagtacagtggcaccatcatagctcactgcagcctcaacctcccaggttcaagtgatccgatcctcccacctcagcctcttgagtagctgggactacaggtgcatgggaaccacacccagctcattttttttgtatattttgtagagacaaggttttgccatggtgctcaggctggtctcaatctcctgagctcaagcagtccactcacctaggccactcaaagtgctgggattacaggcatgagccaccatgtcttccctgtttatttctttatacagctttgagttgctgtgtagtattccttcatttctgtatggacttcctctgtcatttcttgcaggacagctctggtgttaataaattcactcagattttagttatctgggaatatctcaatttctggatcacttgaggtcaggagttcaaaaccagcctggtcaacatgataaaaccccgtttctactaaaaatactaaagttagctgggtgtggtggcatgcaactgtagtcccagctacttgggaggctgaggcaggagaactgtttgaactggaaggcagaggttgcagtgaaccgagatcacgccactaaactccagcctgggtgacagagtgagactctgtctcaaaaaaaaaaaaaaaaaaaaaaggccgggcacagtggcttcatgcctgtaatcccagcactttgggaggctgagagagctgatcacgaggtcaggagatccagaccatcctggctaacgtgccgggtgtggtggcgggcacatgtagtcccagctactcgggaggctgaggcaggagaatggcgtgaaccgggaaggcggagcttgcagtgagctgagatggtgtcactgcactccagcctggatgacacagcgagactcctctgtctcaaaaaaaaaaaaaaagttaaccttcttacttagcaattctgtttcaaagcaagctgaaagatggaaataaatatcagaacataaatcaatgaaaatagaggccgagtgcagtggctcatgactgtaatccctgcactttggggggctgaggtggatggatcacttgaggtcaggagttcgagaacagcctggccaacatggtcaaagcctgtttctactaaaaatacaaaaattagccggccatggtggtgtgtgcctgtagtcccagctacttgggaggctgaggcaggagaatgacttgaacccgggaggcagaggttgcagtgagcagagatcatgccactgtactccagcctggaggacagagtgagactccatctcaaaaaaaaaaaaaaaaaaaaaagaaagaaaattgaaagcagaaaagatttagaaaattaaactaaaagctagttctaaaagatcaataaaatcgacaagcttctagcatgactgacaaagggaaaaagagtgaagaaaaaattaataggagttatcagtacagagcgtgcagacatcaaaaagataaggaaatactacaaacacctgtacaaacataatttgacaagtgagatgaaatggacaaattcctcaaggcaaagcaagacaaaacaaactcccactacccatctataatgaaatagataatccaattaatcatataactattaaagacattgaatttgtagttaaataatttttgaaatagaaatccacatccccagatggtttcactggataattctatcaaatgcttagataattaacaccaattctatataatctcttccagaaaacggaaagcaaatcacttccaaatttattttaaagttaagaaaaaatagtacatgctgggcctggtggctcacacctgtaatcccagcagtttgggaggctgacgtgggcagatcacttgagctgaggaatttgagaccagtgtgggcaacatggtgaaacaatgtctgtacaaaaaacaaaaattatccaggcatggtggcatgcacctgtagtcccagctacttgggaggttaatgtgggaagattgcttagacctgggagacagaggtttcagtgagctgagatcacaccactgctctccagactgggtgacagagtgagactctgtcttaaaaaaaaaaaaaaaaaagaagaagaaaaaggaaaaggaaaacaatacaaagaaagaaaactatagaccaacatgagtcatgaatatatgtgcaaaaattcttaacaagatatcataaatggaattcagcgatatataaaaataattatacaccattaccaagtggagtttatcccagaaatgtaaggctggttcaatgttcaaataccaatcaatgtgatccaccatattaacaagctaagtaagaaaaatcacatgagattatcaattgaattctgcagaaaaggcatttgacaaagtccaacacccattcatgataaaaaccaccagaaaacttagagaggaatttcttcaactgaataaaaaatatttaaagaaaaatcatgtggctatcatattcaataaagactgaatgctttttctctaagatcaacaacaaggcactcattactactattcaacaaaacactgcaagttctagacagagtctcactctgtcacccagtctggagagcagtggtgtgatctcagctcaccgaagcctctgtctcccaggtctaagcaatcttcccacattaacctcccaagtagctgggactacaggtgcatgccaccatgcctggataatttttgttttttgtacagacattgtttcaccatgttgcccacgctggtctcaaattcctcagctcaagtgatctgcccacgtcagcctcccaaactgctgggattacaggtgtgagccaccaggcccagcatgtactattttttcttaactttaaaataaatttggaagtgatttgctttctgttttctggaagagattatatagaattggtgttaattatctaagcatttgatagaattatccagtgaaaccatctggggatacagatttctatttcaataaggaaaaagaaatcaaaggtacaatagccaagatttggaatcaacctgtgtatcagcagacaaatggataaagaaaatgtgttatatatacatgatgaagtacttttcagccatgaaaaagaatgagatccagtcacttgcaacaacatagatgaaattggagaacattacgttaaatgaaatagggcaggcatagaaagacaaacttcaaatgctctcactcatttgcaggagctaaaactttaaataattgaactcatggagaatagaatggtggttaccagaggctgggaagagtagtagcattggggttggggggagtgggaatggttaatgggtacaaatttagttagaatgaataagatctagtatttgataatgcaacagggtaactacaatcaataatagtttattgtacatttaaaaataactaaaagaggccaggcgcggtggctcacgcctgtaatcccagcactttgggaggccaaggtgggcggatcacaaggtcaggagattgagaccatcttggctgacagggtgaaaccccatctctactaaagatgcaaaaaaaattagctgggcatggtggtgggtgcctgtagtcccagctacttgggaggctgaggcaggagaatggcatgaacctgggaggtggagcttgcagtgagccaagattgtgccactgcactccagcctgggtgacagagcgagacttcatctcaaaagaattaaaaaaaaaaagagtataactgaaatatttgtaacacatagaaatgataaatgcttgaggtgatgatggatatcccatttactctgatgtgattattacacattgaatgcctgtatcaacataaatatatggaccccataaatatatacaccttctatgtcctcataaaaattaaaaataattaagtttaaaaaagagtctaggcacggtggctcatgcctgtaatcccagcaccttgggaggctgaggctggcggatcacaaggtcaggagttcaagaccagcctggccaacatggcaaaatcctgtctatactaaacataccaaaattagctgggcatggtggcaggtgcctgtaatcccagctacttgggaggctgaggcaggagaatcgcttgaacctgggaggcggaagttgcagtgagctgagattatgccattgcactccagcctgggcaacaagagcaagactctgtctcaaaaaaaataataataataataattaaaaggcatactaatcagaaaagaagaaaaatttgtccctattttgagatgacgtgatttaactatatggaaagcccaaaggaataaaacaacaaaaacaaacaaaaaactcctaaaaaactaataagtgaatttagcaaggttgcaggatatatcaacatatcaaaattaattgtatttctatatactagcaaggaacacgtgggcactgaaattaaaatataatactatttataattgctccacaaaaatactttggtgtgaatctgccaatacaggtgcggaacttacatgatgaaaactagacaatgctgatgaaagaaatcaaacaagatctaaataaatggaaaggcatagcatgttcatggactagaagactcaattgtaaggacacccgttttccccaaatggtacacagttttaacacaattactatcaaaatccaagcaactttgttgttgttgttgtagatgcagacaaacttatactaaaatttgtttggaaacatacaagccctagaatagctaaaaagttttgaaacagttctgaggtgggaattaaagaaagaaagaaaaataaaattaaaaagagaaaaatatgttcaaaaaaacaagctttctgtattaggctggctcatcccaaagtcagtaacaggcaaagcccagacccaggcaaagtctcgataacattatctaagaagccagggctcaaaggaatgtgctctggagactctcccagcactccctccacataaggagaagaaaaacaaattttccttattttcctttcccctatggtatgagtacatttatgactttatagattcccgttttcttttcttttgttttctttttctttttttttgagatgaagtctcgctctgtcacccaggctggagtgcagtggtgcaatctcagctcactgcaagctccgcctcctgagttcacgccattctcctgcctcagcctcctgactagctgggactataggcgcccgccaccatgcctggctaattttttgtatttttagtagagacggggtttcaccttgttagccaggatggtctcgatctcgtgaccttgtgatccacctgcctcagcctcccaaggtgctgggattacaggcgtgagccactgcgcctggccagattcctgttttctgtaactagtaacctcaagtattctgttttttatccgagcagcacagcaaaggtcatgagacatgcctgagcaggcataatctaactgtcatagtttgattaactgcctttgttctgcttctatacacttgctttcacaccactacacttcgcatcactgtaaccttgtttcaaactagccaaccccttttcagaagtgtgtataaaagtcaagttctgtctttgttctaggcccggtctttggatgttaatccactaggccagagtgcactcaataacatccccctgttctacctattggtctctccagtctcctgattcccacaacagttccactggatctttcactgtctttgtagttttaccttttatagaatgtcacttaggtggggcgtggtggctcatgcctgtaattacagcattttgggaggctgaggcgggtggatcatttgaggtcaggagttcgagaccatcctggccaacacggtgaaaccccgtctctactaaaaatacaaaaattagccaggtgtggtggtatgcatctgtaatcccagctattcaggaggctgaggcaggagaattgcttgagcctgggaggtggaggttgcgataagcagagatcatgccactgcactccagtctgggtgacagagtgagaccctgtctcaaaaaaaaaaaacaaaaaacaacaaattgtcacttagttggaatcatacagtatgtagccttttcaaattggcttctttcacttagcaatatccatctaaggtcttccatgtcttttcatggcttggtagctcatttcttttcttttcttttttatttttctttgagatggagtctcggtctgtcgcccaggctggagtgtagtggcacgatctcagctcactgcaacctcaacctcctgggttcaggcaattctcttacctcagcctcgcaagtagctgggattacaggcacgcaccaccacacccagctgatttttgtatttttagtagagaaggggtttcaccatgttggccaggctggtcttgaattcctgacctcaggtgatctgcctgtcttgacctcccacagtgctgggattacaggcatgagccaccgtgcccggcctgagccactgcccccagccggctcatttcttatcattgaataatattccaatgtatgaatgtgtcagtttgttcattcaccaattgaggggatatcttgatttcttccagtttttgcagttttgaataaagctgctataaacattcatgtgtaggtttttatgtgtatataagttttcaactaattttggtatatacctaggagtgaaattgctgggccatatggttaggctatgtttagcttggaaggcactactagatcatcttccaaagtggctgtattctcaagagcaatgaatgagaattcctgtttttctatgtccacatccttgtcagcatttgatactgtcaggtttttggattttagcctatctaataggtgtatagtggtttctcattgttgtttttgttatttatttatttatgtatttattttagagatgggttcttactctcttgcccaggctggagtacagtggtatgatcatggctcactgcagcctcaaactgctgggttcaagaggtcctcctgtttctgcctcctaagtagctggactacaggcatatgccaccatgcccagctaattctcattgtgttctgaatttgtaattccctaatgacatatgatgtagagcgtcttttcatatggttatagccatatgtatatcttctttggtgagctccgttcagatattttgtccatttttaaactggaatgcttattttcttatttttgcattttgggagttattcgtatatattggatacaaatcctttatcagaaaagttatttgcaaatattttctccaagtctgtgggttttcattctcttagcaatgatgttctcagagcagcagttaaaaatttctgtctagattcttttttttatgtttgcatgtgtaaaatgcaaaacttcctgagtagaagggactacaggtgcatttattagagcagtatttattgaaaagactaatatttttctattgaattgcctttgttccttcatcaaagatcagttgatttcatttgtttgggtttatttatgggttctctactccgttcctttaccaatgtcacactgtcttgattactgtagcttcatagtaagtctcaaagttgagtagtgtgagtactctggccctgcttgtcttcaatattgagtgggctattctgcatcttttgactttccatacaaactttagaatttgcttgtcaatatctgcaaaataacttgctggaatcgttattggaattaaattgaatctataattggtaagcgctaacacattaatgttgagtcttcctacccatgaacatggaacttatctccatttattaatttagattttttatttatttcatcagagttttgtagtttccctcatataaagcttgtatgtattttgttagatttatacctaagtattttgattatttggtgtttatgtaagaggtattaaattttcaatttcaaattccaattgttcagtgttggttaaagaaaagcaatcaacttttgtatgttaaccttatatcctgcaatgtaactataataacttactagttctcagagttttttgttgattctttgggattttgtacatagatagtcatgttatctgcaattttttatactttatttccttcttcctaatttttatacttttatttccttcttttgtcttattgtattagctaagacttctagtacaatattgaataggagtggtgacaagagacatccttgccttttccctgatattaggggaaaagcatataatttttcaccattaagtagtgtatgatgttagccatacatacatacatagtggaattattgtagatgttcttcatcaattgagaaagttcccttctattcctagtttgctgagagtttttatcatgaataggtgttagatttgtcaaatgcttcttctaaatgtattgatataatcatgattttcttttttaacttaattgatgtgattgattacaataacttatattcaaccattaaacaagtatgcatatctggaatacatcccatttggtcatgttgtatttttttcatacaatgttggatttgatttgctaatatttttatcatggataaaaggggcattactatcgggtaaaattcagcccccgatatttcacctgggtccttttctattttccctaagtgttggctggtctgagaaataaagggaaagagtacaaaagagaaattttaaagctgggtgtctgggggagacatcacatgtcggcaggttctgtgatgccccccaagccgcaaaaccagcaagtttttattagtgattttcaaaggggagggagtgtatgaatagggtgtgggtcacagagatcacgtgcttcacaaggtaataaaatatcacaaggcaaatggaggcagggtgagatcacaggaccaatgcgaaattaaaattgctaatgaagttttgggcatgcattgtcattgataacatttatcaggagacagggtttgagaaaagacaactggtctgaccaaaatttattaggcgggaatttcctcatcctaataagcctgggagcgctacgggagaccggggcttatttcatcccttatctatgcccataaaagacagacgtccccaaagcggccatttcagaggcctccccttagggatacattctctttctcagggatgctccttgctgggaaaaagaattcagtgatatttctcctatttgcttttgaaagaagagaaatatggctcagttccacccggcccacaggcagccagactttaagcttatctcccttgttccctgaacattgctgttatcctgttcttttttcaaggtgcccagatttcacattgtttaaacaatttgtgcagaaaacgcaatcatcacagggtcctgaggcgacattcatcctcagcttacaaagatgatgggattaagagattaaagtaaagacaggcataggaaatcacaagggtattgactggggaagtgataagtgtccatgaaatcttcataatttatgttcagagactgcagtaaagacaggtgtaagaaattacaaaagtattaatttggggaaccaataaatgtccatgaaatcttcacaatttatgttcttctgccatggctttagccggtccctccgttcagggtccctgacttcccgcaacacattacatcacagtggaaagtgagatagtaaaggaatattatgaagtactctatgctcaaagggggcatgatccctatgacaaagggatccattcttcgagaagacataacaggctgggcatggtggctcatacctgtaatcccaacatttggggaggccaaggcaggaggatcatttcagctcaggggttcgagaccagcctaggcagtgtagtgagatcccatctacaaaaaaaaatttaaattggcctggcatggttgtgcctgcctgtagtcccagtacttacgaggctgagctgggaggatcacttgagcttggagggtaaggctgcagtgagctgtggtcacaccactgcactccagcctgggtgacagagtaagactgtctcaaaaaaaggggaaaagacatgaaaattactatatttcactgaagatttatgaattgcaaataagcacatgaaaagatgttgaacatcattaggtattacggaaatgcaaactaaagttacacctgtcaacatggctaaaattaatagtgacaacaaatgctggtgagcatgtggaaaaacttgatcactcatccattgttggaatgtaaaatggtacagctttgtggaaaatactttgtcatcttgaaaaaaactgcacttgcagctaccataagacccagtagttgccctcttgggaattgcttccacaaaatcaaatgcttatgttcacacaaaaaatttaatatcagggcttaactgtaatcaccaaaaattgaaactagccctgatgtcctgagcagatgaatggttaaatcaacagtgcagcaaaaccatgaaatactcattagcaataaataaaaactaatgaagtaataatatacacaacaacttaaattaactccagataattattctgagtgaaaaaaaaatccagtaggttaggtaagcatgacattgacataacattgttgaaatcaggaaattacagaaatggaaaacagattggtggttagcatgggttaagaaagtggaatggtgaaagggaagtggtgtggccatacgtgagcaacacaaccccacttaggtagaatacacatcttctcaagtagacaaggaacattctccagggtacagcatatgctaggttgtaaatcaaaccttagtaaatgtaaaggatagaaataatacaaagtatttttaaaaacacaacggaatactattagatcaataacagaaagaaagtcgagaagttgggaaacccacaaaggtgtggaaatttaacagcacactctaaatgaccaatgggtcaaagaagaaatcaagagggaaattagaaaatactttgtgggccgggtgcagtggctcacgtctgtaatcccagcactttgggaggccgaggcgggtggatcacgaggtcaggagatcgagaccatcctggctaacacggtgaaactccatctctactaaaaatacaaaaaattagccgggcatggtggcgggcacctgtagtaccagctactcaggaggctgaggcaggagaatggcgtgaacccaggaggcagagcttgcagtgagccaagattgcaccactgcactccagcctgggtgacagagtgagactccatctcaaaagaaattttataaaaaaactttttaattaaaaattaaagaaatactattatatatagagaatgagggtttaaaaaaaaaagaagaaatactataaacaattgtagcttagatgaaatgaacaaggccgggtgtggtggctcacgcctataatcctagcactttgggaggccgaggcagatggattacctgaggtcaggagttcgagaccagcctggccaacatgatgaaactccgtgtctactaaaaaaaaaaaacaaaaaattagccagtcgtggtggcaggcgcctgtaatcctagctacttgagaggctgaggcaggagaatcacttgaacctgggaggcagaggttgtagtgagccaagatcacaccactgtactccagcctaggcaagaagaatgaaactctgtttaaaaagaaagaaagaaagaaagacagacagacagacggaaagaaatgaatgaacaaatttctagacagacacaagcttccataactgactcagaagaaacagacaatccaaatatgcctataataacaaataatgagattgctttagtaataaaaaaaaactacccaaaaaaactgcgggcccaaatggctttactattgaattccaccaaatattttttttaaataccaattcttcacaaactcctcaaagaaaaatagaaaaggagggaatacttcccaactcattcacggattctataaggcaacatcaccctgacaccaaaaccaaagacctaacaagaaaagaactctttagacaatatattttataaatgtggacccacgaaaaccctgaaaaatacaatgacatgtaaaagtattgtataccatagccaagtgggatttatctcaggaaggaacagatggttcagcataaaaagtcaattaggctgggtgcagtggtcacacctgtaaccccagccctttgggaggctgtggcaggaggatcacttgagcccaggagttcgagaccagcctgggcaacatggtgagacctcacctctacaaaaaaaatcacattagcttggcgtggtggcacaagcctgtagtctctgctgcttgagaggctgagcaggaggatcatttgagcccaggaggtcgaggcggcaactgagccatggttgcaccattgcactccagcccaggtgacagagcaagaccctgtctttaaaaaaaaaaatcagccagccacggtggctcatgcctgtattcccaacactttgggaggctgaggcgggtggatcacctgaggtcaggagtttgagaccagcctggtcaacatggtgaaaccccgtctctactaaaataaatacaaaattcagccgggcatggtggtgagtacctgtagttccagctacttgggaggctgagacaggagaattgcttgaacccaggaggcagaggatgcagtgagctgagatagcatcactgtactccagcctgagtgacagagcaagacaacatctcaaaaaaaaaatcaattaagtagaattagaagggaacttcttcaacctaataaaggacatctgtgaaaagcacacaattaaatataatacttaatggtgaaagactggatgctttcctcctgaaatcagtattaagacaaggatgcccactcttggcacttctattcaacattgtactaaagggtttggccacagcaattaggcaagaaaaaaaaaaggcatccaggtaggaaaagaagtaatactatctctattcacagatgacatgatcttatgtaaagaaaattctaaagagtccaaaaaaaactattagaactaataaatgagttcagcaagattgcaggatataagatcaatatacaaaaatcaatgtatttttatacacttgtaatgaaatggaagtgaaattttaaaaacacttccttagccaggtgtgatatgtggacttggtagtcccagctacttgggaggctgaggtaggaggattgctggagctcaggagttctagacgagcctggacaacatagcaagattccatcttttgaaaaaaccaaacagctccacttacaatagcatcaaaaagaataaaatacttgggaatgaattttacaaaagaactataaaacttatattctggaaacttcaaaacattgttggaagaaatgaaagaaaacctaactaaatggatagatgtttatgttcattgattggaagacctgatactgttaagatagcaatctcctcagattaatctatagatcatcacaacccctagaactgcagctgatttctttctagaaattgacaaattgaccctaaaatttataaggagactcaggggccccagaatagcaaaaacaaccttgaaaagaacaattacattggaggactcacacttccttatttcaaaactttctataaagcaacagtaatcaagacagtgtagcatagacatatttcaacacaatacaactgagagtccagaaacgacccaagtgtctctggtctcctgattttcaacaagggtgccaagaccattcaatggggtaaaaatagtctttcaacaaatgatgctgggacatctggatggacacacgcaaaataatgacattgaactcttcacataatatacaaaactttactcaaaatggatcagagtattcaatgtaaaagctaacattatgaaactcttaatagaaacataagggtgaatgtgtatgaacttggatgtggtagtggtttcttaaatatgagatcaacagtgtgagcaacaaaagaaaacatttgagatagggccttagtctgtcacccaggatggagtacagtggtgccatcacagttcactgcagactcaacttccggggctcaagtgatccccccagcttagcctccctagtagctgaaaccacaggtgtgtaccacgattctggctaattcttttattttttgtagagatggggtcccactatgttgtccaggctggtctcaaactcctgggctcaagtgatccacctgccacagcctcccaaagtgttgggattacaggcacgagccatggcacccagctgataaggaatattttttatgcagaatagataaaaactctcacaaactcaatgataaagacaatccaattgaaaagttggcaaaggatctgaaaaataagacacacaagtgactaatatgcacatgagaggttgagcaacatatcagtcactagggaaatacaaatcaaaaccactctgagatatcatgttatacccactaggatgcctttacttaaaacaacctgataggctgaatgtggtggctcacacctgtaatcccagcactttggttggccaaagcaggaggactgcttgagcccaggagttcaagatcagcctgggcaacagcgagacccccgtctccataaaaaagtataaatatacatacatacatacttggtaataggaaatgttggcaaagatgtggaaaaattggaaatctcatacactgctgatatgaatataaaatggagcagccacactggaaggcagaatggtagtttgttaaacagttagttatagagtgatcatacggctcagcaattccactcctaggtctatatattatatatccgagagaaatgaaaacacatttccacataaaaacttgtacgctgatgtttatagtaccattatgcataattgccaaaaggtggaaacaatccaaatgtccatcaacagatgaacaggtaagcaaaatgatgcatacaatggaatattatttggtcataaaaagaagtggaatagtgatacatgctacaacatggatgaaacttgaaaatattatgctaagtgaaagcagccagacaagagcaatattctgtgattcaatttatatgaaatgttctgaataagcaaatctatagagacggaaagcaggttgatggttgcctcagaatgatggggatcggggatagggcatgataaagtgtatggggtttcttactgaggtgatgaaaagattctaataatggctgtggttaaagtgtatggggtttcttactgaggtgatgaaaagattctaataatggctgtggtgatggctgcacatatgatgtgactacactgaaaatcattagattgtaaatcgcatgctgttaactatttcagtaaagccgtttttttttttttaagcaaaacatgagccatccttttctttttttttgagagtctcgctctgttgcccaggctggagtgcaatggcatggtctcggcgcactgcaacctctgcctcctgggttcaagtgattctcctgcctcagcctcccaagtagctgggattgcaggtgcgtgccgccatgcctggctaattttttgtatttttagtacagacagggtttcaccattttggccaggctggtctcgaactcctgacttcaagtaatccgccggtcttggcctcccaaagtgctgggattgcaggcgtgagccactgtgcctggccataatcttttcttttttgagatggaatcttgctctgtcacccaggctggagtccagtggcacaatctcagctcactgcaacctctgcttcccaggttcaagcgattctcctgcctcagccacctgagtagctaagactacaggcacctgccatcacacctggctaatttttttttttttttttttttttttgtagttttagtagaggcagggtttcaccatgttggccaggctggtctcgaactcctggcctcaagtgatccacctgccttggcctcctaaaagtgctgggattacaggcgtgagccattgcacctgtcctgagccatcctcctgaggaaaacgtactccatcttgagaaaaaccaacagacgtaggaatagagtacctaggttatagagcaagtatatgtttaattctatgaggaacgatcacactgtttatcaaagtaactattcttcctaccagcaatgcatgagagttccagttgctccacatcctcactaatacacattattgtctttttaaaaaatgtaagccattctaatagatatgtgttgttactgttatttcttttgctgtacagaagctttttagtttgtctaatttgtctacttttttgttgtatttgcttttgagtccttagtcataaattctttctttctttctttttatttttttattttttttgagacagagtctcactctttcgcccaggccggagtgcagtggcgctatcttggctcacttcaagctccgcctccctggttcacgccactctcctgcctcagcctcccgagtagctgggactacaggcacccaccactgcgccaggctaattttttgtatttttagtagggacggggtttcaccgtgttagccaggatggtctagatctcctgacctcatgatccgcccgcctcagcctcccaaagtgctgggattacaggcgtgagccaccgcgcccagctttttaaattttttttgagacagtctcgcactgtcacccaggctgaagtgcagtgacgcgatctcagctcactgcaacctgtctcctgggttcaagcgattctcatgcctcagcctcctgagtagctggaattacaggtgtgtaccaccatgactggctaattttttgtttttgaggcggagtttcactcttgttgcccaggctggaatgcagtggtgcaatcttggctcactgcaacctctgcctcccaggttcaagtgattctcctgcctcagcctcccaagtatctgggatgacagccatgtgccaccatgcctggctaattttgtattttagtagagaggaggttttactatgttggtcaggaaacagtgtgatcattttgggtcttgcttttattttttggtaggtggatctgaagcagtgctgccttagtctccttggactctcagctccatttcctcagctcaagtagtccactgggctctacctcagttctgcctcctcttgctgtggcctagaaattctctctggatatcagaaaacaaaggacagtaatccctgccaagatgggatacaaacaaggtgagccccatgattgcccaagcgtactacctggagtgtcttcttctgtttttttctttttcttttttttcttcaagatgggatcttcctgtgttgcccaggctggagtgcagtgccatgatcatggctaattgcagccttgaactcctggcctcaaatggtcctcccacctcagcctcccatgtagctaggtctccaagcgcatgctactgtgcccagcatggtatccagtgtcttgaaaccaccattgcatgtatttttgacgggctcctttggttgtttcaggtagaagggtcaacctggtccctgttactccatcttgtctgtaagttgaaggccttgatgttttctgcttatctcttcatcatctccaaacggtggtggtaaagtcactcacgactgctgtttccttcaagggaggaaacgtgcgaagactttgcccacacaatctcaatttgtcctcataacgttgcagatttttttttttttttttttttttgagacggagtcttgctctgttgccgaggctggagtgcagtggcgcgatcttggctcactgcaacctctgcctcccgggttcaagcaattctcctgcctcagcctcccgagtagctgggattacaggtgtgtgccaccacacccagctaatttttgtatttttagtagagacgggggtttcatcatgttggtcaggctggctcgaactcctgacctcgtgatctgcccaccttggcctcccagagtgctgggattataggtgtgagccactgtgcccgaccccagtgcagatttttttagtctcaatctctatttgacagctaaaaaactgaggcccagatgtttgctggtttggagcccagacaggcctgttggcatatattgcttcctggagctccacaaagctcgcaatgtcttgctgcatagttgctaagggagctgcctcacctgcacagcaagtctctggctcttcattccttaagagtcccacttgcagcctggctttttatgtgtacacacacacacactcacacaaactatcctggctttatttggcatgaacacatgcctgggtctcatccagccacttgacatccgagtgagacatggagtggaatggctgctaggccagagatcagtggtcagttaccccggcctctgactccaagtccaaggctccttctccaggctcagacccacacactgggtggtggtgacaaagatcaggacccaggagtgggtggtactcagccctcactgtgcttaaagattctgtgattctgtttcttctcctgtagatcaacgtctggatcactttctaataaaattccaactttgctgataattctccaatatacccaagactgtaaatactgatttcctttcatgaaattgtccaaacagctgcagcccttggtgcacagtatgatctggacctggggcacagcaagaccagaaccatgaaccaccatgaaccatgactcctcacttgtgagatgacgtgtgcaaggtgacctatggtgcttcatgaccacagaagtgaccactctacactgtgaaatgaatttctgcatggggggtatattagggttctctacagggacagaactaatagatatatatgaaagtttattaagtattaacttacacaatcacaaggtcccacaataggccatctgcaagctgaggagcaaggagagccagttcgagtcccaaaattgaagaacttgggagtccgatgtttgagggcaggaagcatccagcacgggagaaagatgtaggctgggaggctaagcaagtctcatctcttcacatttttctgcctgctttatattcgttggcagctgattagatggtgcccacctgattaagagtgggtctgccttccccagcctgactcaaatgttaatctcctttggcaacaccctcacagacacatccaggatcaatattgcatccttcaatccaatcaagttgacacgcagtattaaccatgacaggggggaatgagatgacacaaaggatcccttctggctctcatgttctgtcaccatctacttcaggagagagatgcactgtgtggggaggatgaaagttagaaggaaaaggcaagagaaatcaggagggtttggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagctta

SEQ ID NO: 26 - DNA, 13802 bp, Homo sapiens
acagtagattcacatcctcttactcaatgtaacaacagatggatttaccttttcccatctttcttatgtctgaccaaacacatagtagggttgaacttgtagaactaatagtaatagaatgccactccactgtgccattttctatggagctgaaacaaacatgatacaattgactttgatagactttgttacttgggataaagcaaacccaatggcctgaagaacagaaaagaaatgcttccaattttctcattttaattcctgagctcagagaatcaaagactgtatcaaccatatagcagggttggggcatttccaagctctttctcctcctaaacctccatcactggggtctttgacatggtaaagacaaaagatggtatctttgtttccgagacgcagattcagtgttaggaagcaattgtgatgggaacagtcatgggaaaatgcttctaggattcatttactgtttctgataaagagatcaatcctcctgcttgtgggggagagtatgaattccttctttcacagcactcacaccagatggaaggatggtgttagacactctatgtagggatgggggctataaacatccattgctcctcttgcttaaaccactgccagaatttgggaggaatattgatgaattatagcagcatcacacatgccaggatggtatggaataaaaggattccaacaataactagttggacagtgaggcaacgatgaggatctacctcctctatttactggcaagcaacaggtctggagagacttctcttcctttaaagttaaataaacagaaacaagataatatgaggtcttagaagaaaatccaccatgttaacagtaaggaaagtgatagcctggataccgtgaaaagtacaattttcaaacacacacacacacacacacacacacacacacacacacacacacacacaacagtcagtattgactgttgacccaagagccatcccctgtcttgttattttctggctaagttcaccgtatgacttggtgggggcgggggcagggaatgaccctactcccaaaacaagggacaaattctgatgtccctacgccatcaaggtgttccgataccttttgcaagttaaataaaaatcttttatatgatatgggagggaagttccattagaaggcttctaggaaaggttctcttatctctaagaaggacaatccagtggcccgtctctgccaccagacagtaccatgtctgtgtgtgatgcctggaactgctgaaacaatcttgcatccatgaggggagctgggctgaggttgccctcatgccaagataagaggatgaagaggagagcttgaaagaatgtgggtcctcaatgacattcatgggcatctcattcaaccaactctaacacttgacttcctgttctagaagataatacattaacttgctgcttaagccatttttattcattttttttctgttactggtatcttaatctaaacaacagaaagtagaagtgcattttaggttccttgaagtttattgaaaacgaaatgcgagaaaagatagaagaataaaggaaattaaaggtgaaataataagactaagacaacagacttttcccaaaatagatcaagttaagaagtagctagaaaaaatatttactgggtgaggtaagaaacaattgtaaagaaaccaaaatgcaataccagaattaaaatgggcactggaatctgtaatgagaataagcaacaggcttgtggagaattaatttgaaaaacttggaaattaaaacgcaaggaaagcagaacaatacaatgtatatttcctttgtatatatcatctgctcatgtgtgttcatgtgtgaagggaacaaaaagacatttttagagaaaagaaaacaaacatataaaagacataattgctgttacagaagaacagaataaatggaacagaagcacattatgtgtcctttcttatcaggacacaatattaaaacaactcattggcaaaataaaaacttaaatcttcacgtgtaaagagttctccacctacaacttaaaaatagagcctatattctgatacaattgtttaaatattattgatgtagaaatactcagataaacatctaggctggaaaatggctatgtataaaaaatcagaaactacgttactcatacattttcttgcccaaatttaaattccagaaaacaatgaaacaaaatttttcaagtaaaaatgatgtggctaaaaaattatacagtaaatagtttttcatttgcgaagctacagaaaggcattccctgacacataaagaataagaagttatgttggctctgattcttttccagagggttgggtagctgataaagctagtcaaggatgtgagtccagaaatagagaaaaaaacatccacaagaatggaagaagtcttgttataaaaaaagttgatttggtaaacacagatatgagtgtaaaaatcacaataaatgtgaatcaaaacagaatgaactataagaggtaatgcttaaagagaaatcagatttaaaaatctaatataaaaattcttggctaaaatttccaattgtattaacaaaaaccaggaagtgggtgactgatacatcactaggaataaaagtatattatcttcttcacctttcataatggatattcaatgtgtactatttcaatcctgacactcttaattgaagaacacaattttaagcgaatgtgtatgtactgtacagggtactgtagaggtgtgcatgtgtgcgtgtgtgtgtttaaggcatcaactactagcataacaagaagaatgaacaggattcaaatagagataaaaaaacaaaacaaaagaaaaccctgacttctagtacaagtgcatctggcatccaaattttgttacttgtttgatagaagcacctgccaacatagaaatcaacattaaaaaaactgtgtaataccactgaaaactacactgtcctgacaagcaaatgagaaatcatcctgtagaggtattttcataatccaaggcacattaattcccacagaacaaaactgcctccactaaagacgaactcatagtaaaaaataaattataaagaatgacaagagccttgtaaggaatcttatccccataggagagagtcagaagtcatcatacacagaaaaatacacctctcaagaattgaaaataataaaacaatcaaagagactattaagtaaatacatttagattgattaaagagaaaaaagaaggaatatgaaccattgcaataatgcacacatgacagaaaaaggataggtgggtttgaaaaatatacattcaacttcttgagataaaaaaacatagtcattgaaaatagaaagaaagtaaatatgtatataagaacagacatggaacataacacaagttaaagatacagcagaggagctgaaaaaaaacagcaaaagctggctctttcctttgaaaacaccaacaaattagacaaacctctgccaaaaaatgattaaggaaaaaagacacaaataagccacttcacagttgttagagactgacagaacatttttagcccaggcttagactggagaatgattaatgaccagagaagccctgagacacatctcaagactctgatggacgtggtcagggtcagctggtaaacaccagcccatcacctgggtgctagctttttaaaaaagaagtcatattttgagatcattacagattcacatgcaatcgtaagaaataacataaacgggtcttaaatacccttcacccagttttccccaatgttaacacttgtgtaactatagtacaatattataaccagaaaattgacatatatgttactgatcttattcagatttcattagttttacatgcgcttgtgtgtatgtttaatttatgcaattttatcccatgtgtagacctgtgtgaccaccatcacagtcaagatgcagaaatggttacatcacaaggacctctcatgcaatggaacactagcgctgagtttcttctttctacactaagacctggttactagattctgggagactgcagcaataatgaaaagaattgtctctcagtgaaatgccaaactccgctagggatcgacaaactgggatcccatctttcctgatgctcctttaatccaggcttccacaggaccacaatatgtggctggtcatacatgctgtgcactgttcaattttagagggtgtcattcctttgacggccttgctcttgtgatctacaagggccatcaatcttgacttgttccagtgactagcggttattattttcattttgagtaaatcaagtggaaagtttcacccatctggtctagagaggaagcaataagcaaagcatcagtctatggacttagttccctaagagctgaggcagagttaggaaaggagacctctgttcagagattcttctatgtgtctggagtgaactgggccacaataaagggttttgtgcatgtcatgtgtgtggggagtgtgtgtatcctggcaagcatgtgagttttcccttacctcttctccaaccagatataaatggctttttatctgttttagaaaataaacatctaggtataattttgttcaaaaaagggtttcactattttttaaaaaactttcaaaataatttttttctttttgtcaaaattctatcaaaatcagtgaggaaagaggcagcaaaaatgctgataccagtgttccacagcataggttgtataaacaatacatttggaaaaaaaatgaaaggtcgttgagtttgccagagcaacagatgtttagtagtgatagggattctctgtggctggccttaaccacttagtgatcaaactaggaagtgagggaataaagctgaggggcgtgcatggaatcctggaagtattttgttgcaccacaaagaagaagggatataattatggactttttaagtcttttaactcactggaaatataagccctttttggtaacatgtaggttgattatttaattcttgcatattcaccatccatttatactttcagagacacttgttgttgaaaataatggccttaaaaaatgctgaactttgaccggtagaagaataacccataaatagacattgaaatatacgcctaaagaattttataaactgatgataaagtagagtacaaatattggttggcaaagaatggattcccagagagtgtattatttttcagaagagaatgaagtatattaaagtagatgaaactgtaaggtggcttagtgttagaaagattaatattattggaaagttacttcatgctttcagtaagaagttctgcatgtgactatggcttgttaagataaatagcatatgcaaaagaacttagaagaacatgtcttggtcagtaagttactcaaagcataaataataaagaaaggtaaatcacacagttttaatattcttgcaagcatgaagggagtgataagggtgtggcatttgagaggagtttatatggaaggaaagactgggattaaatgaggaaggatctgagttatagataaagggattgattgaggcagcaagcacaagaaatggaaagcgactctgcatgtcagttctgtgtttcacagagccactaccagcataaataaaacccggtattgatagatccatgtggactcacctgcccctattctcaaaccatcacttaaaggaaaacttgggcaggtgaacttatcctcaaagtggggccctgtgttgacagggactgccagcaactcggacagtcttctgccttgaaaattctagagtgtttgaagaatctgatatattgaggaaaacggcaagtccaataggaaagactgagaggctcacacaatactctctgaagacagggtagtggtctaacacgtacagactttggacatgaatagggctgagtgagaaccctgacaccatcacctactgcctgtgtgattttgggcaagttactcaatctctctgaaccagtttctgcaaagcctttatggctagtatctctgaaaactggagatagaaagagaaaatcaagcactgatttataattgttagaagctcaacacatcagaggttataattgttagaagttcaacacatcagaggttaatacaacagaagaagagatagtcatttctctccatggccaggatcctcaaatctgctgcccctctctttccctatccatagtggctgaaacaacatccttacaactccttgaatcccctcttccttctccatgttcttttctccaaaataaggcatgagaactttttcaaaggccaaagctgagcatgtcacctccctgctcaaactttttattggatgcccactgtcctttggctatgttccagatttaagatatttaatatggcttcaaggctatgattggtctagctctcaccaatctcatttgcctcatcttgtgtctctctgtcctttcccctctaggctgcagccacactgtctcctcactgaattctcgcccacctgagaatctgtacaggacgtgctattctcctggagtgtttataacttttcccccaaacttccaaggccacgtggactcctattcatccttcagcactcagctcaagtcaattcctcctctagaataaacaaacccatctgtggtatgaatgaatggtggttaccaattgggttgagtaggggcaggggatggctgggaatgggcatgagggatcttcctggcaagtctgtatattactagggggctgggttgcaaagtgtatgcaattgttgaactcataaaatggaaaacctaagatttctgtgtttttttgcaagtaaattttatctcaaaggaaaaaaccagactcttgagtcggcattaatgatgtgtacagttaaatattgggaggaaagggaagtgtagtgatgtctaaaatttcctttgatatgcataaaaattaagatggattgaaggatggatagatgggaagataggtaataaaataaatatagtaaaatgttaatagtagaatctaggggatgactggtcactaaaagtattttaacttttctgaatgaagatatcaaggaagacatctctgtctgcctccatccccatctgagggtcccatgttatatcctaacagtatcattttcatgaattacaatatatgtatattcctgaacatacatcgtcttcatgaattactatagttattgaataatagtgagattagtatcttatccttcaccggactgtaagctccatgaagacaggtatcatatctgtgttgtttactcgtgtatctccagaatctagtgcctactctggaaacactcatttgttaggtacaccttgctctctgaaatccaccctccaccttgttgataaatacaatgtttgtttatcttcaaggttcatctgtcatgtcttctaattcttttggtgaggatatcatgatctctatttcctgcctcagttccatttgccttggtgagtgtggggaggttgataagccacatttactcaaaatgcatatcttctcctgatgggcttctggtgattttaactacactcagatccgaagctcttctctcagagtgaaaatgttcagcttcactgtggctccaggggactggacatgatttggagtttctcattggctccagggttgtatgtgcactgaaaacaactggcccagaattttgtattatgtatatatcaccaaactccataacctgcacacttatgggaagatgtgtgatagaaggaaaagactaagtaatgcctcacactgaaaatacagactgctcctattttctatctctcattcataaaaattataataagactaaggaatgcaaaatagttgcagagtaatacttagctaaactagaaaaactcaattttgacaggtttttacaatcttcagcctgacaggtgactttgtcttttgttgatgtgcaagaaagagaaaatgaaataactaaacttgtctgaaagatgaaatttaaatgtgcaacagatgtttgaaagagtttgccattgttgtgggtggataaaagcttcctttctccatttcaaactatgccctggatatttaggctgagtttgtggatattatgaactacaaagacaacgggacattaagacaatggaaagaacacagtttgggagttacaagacctgagttttcatcctggtgttaccactaaattatcttgcacaattaccttcacctttgtggaccttaattttaaaaccaggcagctgaattagaccaatgcttctcaaggtgtaatgtacatatctagagatcttctataggcagattctaatacagtgggctgaagtgtggcctgagagcctgcatttgtaacaagctctcaggtgatgctgatgatgctggtccatggaccacaccttgagtagtgagggattaggtggtctctaagggagcttccagttaaaagatacaatgtgttctttaaaggtcctggaatttctcttaaaaaagcaaacattattctttctgctcttactgaatgaatgaagtagtacagcttagtattgttcaaaaccaaccaaaaaatgcaactaattaaatctgatggccttaaccctggaaagaacagatacctaacactctcataagaatgaataaagcagtgtgtccccatcaaggttcagcctggctgatcctcaggtgctgaattatagaggctgatcactgaaatgccaaactactttgttttatatagtagattccaaatgctagtaccgtacaagagtcattcaaagaacatactaaatatagattcctttgctccatattctagacataaggatttagtggctttagtttggggccagtcatgttttgggaactactgttataaccattttatgggggggcaggatagcacctagggaagaagaatggtaagtttgacccaattccttattgggaacatggtaaagatctttctgtctgtctgtctccctccttctcttctcccttccctcccctccccttcccttcctctctctcttttttctttctttcctttctctctctctttctctctccttccttctttccttccttcttttcttttctttctttcatggagtctagctctttcgcccaggctagagtgcagtggcatgatcttggctcagtgcaacctctgccacctgggttcaagcgactctcctgcctcagcctcccaagtagctgggataacaggcacctgccaccacacccggctaatttttgtatttttagtagagataagatttcactgtgttggccaggctgttctcgaactcctgaccttgtgatccacccacctcggcctcccaaagtgctgggattacaagcgagagccaccgtgcccagccagaagatctgtttttcaagcctgcttgccagcctctgaagaatcctagtgattctcatagtaataaaggtgtgcaagtcataagggagtcaatgttacagggaaacagtccctgaatagttgcccttatgggatgtcaaagctttgaggatccctggcagctgcaatgagaggtctggactgtaattcctatcttcttgtctattgaaatgcatcagaagaaccagggttaaatcctggctctactacttattagtcaaaggctttgggcaaattaattaacatctcacatgttaagccatgtattagttatccactgctacttgacaaactacccccaaccacagcagcttaaaataacaaacatatacgatctcagtttctgcagatagaaatctggttgcagcctagatgtgtatctctggctcaaggtcttttgtgaggttgcactcaagctgaccgctgtggtaatgatctcatctgaagactcagctgggagagaattcaagttaactgatttcataatcactgacatgatactgacagattcattttttcatgggctactgcagtatgggactcagttccttgctggctgttggctgggcatctccctcgatttcttgccaataggtcaacttacaatatagtagctagcttcccaaggaacagacaagtgggagtgagagagagcacccaagataaaagccacagtcttcttaaagacaaatcttgaaagggacatctcatcactttatcatatcctattcattggaagccagtcactagatcttggctgcaatgaggaagggcgttatataagaatgtggcataggaggcagggatcattggggccatcttaaagtttgccaaccacaaatcctaatatcattctgcaatgtttttgtgagaaccaaaagaggtaatgtcgatgaaagaacatttaaatatacacatatgagagtatattataataattcattccaaggagtccagtcaaaatcttccagctgactttgcttagctttgccaagtattccaaggcattcacttaataaaagttttttaattcatgaaagcttctaaagtaccctctttacacttttccaaagagttttccaagatctgatttttcaaggaaagtaaatggtttaattttccttatcacatgaattgccattgacaacaatctttaatcgttaaagagttaacaatgtactttcaattgctttacgcagataaaaaatccattccctaagacaatgaattagccacataattgacagccaattccagtaataaaacgctaattaagtgataatgctaagtaaaaaatataatgtgatgaatttgctaaacaatggcctaactaataaattttcatgctaaataaatgatttggaatggtgactaaaccctcaccacatttagggtcagttgaaaaagcaatgatgctttcagaaaacaatgacagaagtgactgtgccagctaacatccttaacagtattacactgggctctttgccaagcagggccaagggactaagtctgaatggggtaggtgtaccggaatctggggggctggagcaatcaccatgatgatagtatgggtgactagcctaaagaaaggcatggaatagccaagtatagccagctgtagtaatagcagaacccagcaatgggcaagaagatgcagaaatcaatgctagatcatcttgagctaaagaagatcagggtcagcaccaaggacagatcctggatgcggtggctccgggaagattcctgcagatagacgtgttttgtcataaacaaggaagtcaaagattacagagttttctccttaccccagaaggctaggctagtggtgagactcagctctcataggcacaagggtcttcactattttttggaagcaccatggtttcaacccatttaatttacaatggtaccttctgaaaggatctaaatttagaggagaagtccatatttcttatgggttccactggttttgactgacctttacagctggaacagggttctagcttccacatatcaggcacatgcttgccttgggagcctctaatagagacactctttcctgacatggctcacatctgttacctttttaaagtctttagtcagatgtcatcttctataaaactgcaatcctcctccacttatgactcctgatcccattcagcatgttctattgtttcagtgcaccctcacttgttattatgtcatatcatataatgtacttatcttttgctgtccattgcttatttcctgtctctctttccacttcctaccatcaatggaatgtaagctctagaaagacagggaatttttaatttctgtattcttcactgatgtatattaaaagtgcataatatgtcaggcacatagtaggtgctcaacaaaccttgttgaataaatgagtggcagcatgttcagaagcttgttacactctaacctctgaagagagtagtgcaatcttagaaatcagtggagtaaacaagagcctatatcctctgattttaagacaccactgtcccagtatgccatcctcttacttagtggcttcagaggtgtccgcatatttctcactattcgggagggagtacattatagtagtaggatcatatgcaagagaaagattaagtttaaatcctagctctactactaatagctatgtgaccttgagcaagttatttaatctccctgaacctcaatctccacatgtgtgaaagaagcctagtaccaacaataatcatcaactcataggttttaaggattaaatgatataacgtatgcacagcatctagcatagtccttggcacacagttagggctcaataaatattagtttcttgtactttcccatttaaatacaatatgatacatcccttaatacataagagtaaattgacttttcagattatgccagatattgggaaggctcacaagggcatgaaattggagaagagtaagctgtgactggggaagtgtaaaaggctagaagcctagagccctctggaggagagaggggagatcacaagggtaggggcagtaggggacacaaagtgggtctgaagagtgttccctctgttttccagggctacactgagtggtagagagtccaaggaagccagtatttggtgatggggcctttagaactgatgactaggacaaagatacaaggattaggactttctaagaaatggaggtgcaaagtgcaccatatatctctcccagactagtgcaatggtcccctcccttgtcctcctccctcaaccttcctctatgggattaaaatctaagagtaaccctagtcatcgctatgtctgcaggtcctcattgtcccagcaatgcataagatcagttgactgaatactgaatagtgaaagtgaaccattgtgatctatcctgacttaaaattagcataatgattcattcaacaaataccactcaatcgtattcataggccaagcaccatactagtctccagggatatagtagaagcccggacagaagttgtctatgcaatcatggtttaaaagtctggtgaagatgacagacattagccaaaaaattattaaatgaataaacatttgcatacaagaaatttctgacacatgctaagagggactagaatgtagtaaaattaaaaaaaaacaacaagtggccactgtttagatagacaatttagggaatccctcaaaagaagacatttaatcatagacctgaaggataaaaagtggctaaacagtgaaatatagagtggaagactgttctggaaagagcaaacagaattgtgaaagccatattttgggaaatgcttagtgttttcaaagaataggaaggaggtcaatatgactggagtatattgagcaagacagagagtagccagagatgagactaaagatgctgacagaagtcatgtcattctgagccttgtaggccacgaggttaatttttacttcatctggagggcaatgggaagccaataacggatttttggttgagcagtggcattgtgagtttgttttttaaaattgaagaacacgctaggcaaatggctatttcataaataaagcataacaaagatagtgagttattggtatacttctgctgatggatcaatatgaaaggagaatgatgggatagaataagaagggttacagagagggtgacagggaccagatttgcaagtgtgtgtatttgctagaacacagctggctgaagattcactggatgaccatttgggtctccactgcagaagagacagaagtgactgttagtttggaatgactcctatgttctgagcctctgtcatgtctgtacatcagtgggaatttcatctaacctagatcaaagatcctgaagataaaaggtttcaccttggaaaaactcaact
